(12) United States Patent
Morales et al.

(10) Patent No.: US 12,268,720 B2
(45) Date of Patent: Apr. 8, 2025

(54) BACTERIOPHAGE FOR TREATMENT AND PREVENTION OF E. COLI AND B. FRAGILIS INFECTIONS

(71) Applicant: Armata Pharmaceuticals, Inc., Marina del Rey, CA (US)

(72) Inventors: Sandra P. Morales, Sydney (AU); Igor P. Bilinsky, San Diego, CA (US)

(73) Assignee: Armata Pharmaceuticals, Inc., Marina del Rey, CA (US)

( * ) Notice: Subject to any disclaimer, the term of this patent is extended or adjusted under 35 U.S.C. 154(b) by 846 days.

(21) Appl. No.: 16/968,132

(22) PCT Filed: Feb. 7, 2019

(86) PCT No.: PCT/US2019/017129
§ 371 (c)(1),
(2) Date: Aug. 6, 2020

(87) PCT Pub. No.: WO2019/157231
PCT Pub. Date: Aug. 15, 2019

(65) Prior Publication Data
US 2021/0369798 A1     Dec. 2, 2021

Related U.S. Application Data

(60) Provisional application No. 62/627,725, filed on Feb. 7, 2018.

(51) Int. Cl.
*A61K 35/768* (2015.01)
*A61K 45/06* (2006.01)
*C12N 7/00* (2006.01)

(52) U.S. Cl.
CPC ............ *A61K 35/768* (2013.01); *A61K 45/06* (2013.01); *C12N 7/00* (2013.01); *C12N 2795/10132* (2013.01); *C12N 2795/10332* (2013.01)

(58) Field of Classification Search
CPC .................... A61K 35/768; C12N 7/00; C12N 2795/10132; C12N 2795/10332
See application file for complete search history.

(56) References Cited

FOREIGN PATENT DOCUMENTS

| EP | 2893933 A1 | 7/2015 |
|---|---|---|
| JP | 2009532055 A | 9/2009 |
| JP | 2016509998 A | 4/2016 |
| JP | 2017507913 A | 3/2017 |
| WO | 2007113657 A1 | 10/2007 |
| WO | 2014130540 A1 | 8/2014 |
| WO | 2015104388 A1 | 7/2015 |

OTHER PUBLICATIONS

Bruttin A, Brüssow H. Human volunteers receiving *Escherichia coli* phage T4 orally: a safety test of phage therapy. Antimicrob Agents Chemother. Jul. 2005;49(7):2874-8. (Year: 2005).*
Buc E, Dubois D, Sauvanet P, Raisch J, Delmas J, Darfeuille-Michaud A, Pezet D, Bonnet R. High prevalence of mucosa-associated *E. coli* producing cyclomodulin and genotoxin in colon cancer. PLoS One. 2013;8(2):e56964. (Year: 2013).*
Extended European Search Report mailed on Nov. 10, 2021, 12 pages.
International Search Report and Written Opinion for Application No. PCT/US2019/017129, mailed on Apr. 22, 2019, 12 pages.
Dejea et al. (Feb. 2, 2018) "Patients with Familial Adenomatous Polyposis Harbor Colonic Biofilms Containing Tumorigenic Bacteria", Science, 359(6375):592-597 (7 pages).
Hernandedz-Luna et al. (Jan. 2016) "The Role of *Escherichia coli* in the Development and Progression of Cancer", ARC Journal of Cancer Science, 3(1):1-11.
Purcell et al. (Feb. 2, 2017) "Colonization with Enterotoxigenic Bacteroides Fragilis is Associated with Early-Stage Colorectal Neoplasia", PLoS One, 12(2):1-10.
Shields et al. (2016) "Reduction of Murine Colon Tumorigenesis Driven by Enterotoxigenic Bacteroides Fragilis Using Cefoxitin Treatment", the Journal of Infectious Diseases, 214:122-129.
Steele et al. (Jun. 1976) "Prevention of Low Temperature Denaturation Injury in T4Bo Phage by Low Concentrations of Traditional Cryoprotective Additives", the Journal of Hygiene, 76(3):453-458.
Bolocan et al. (Nov. 9, 2016) "Phage therapy targeting *Escherichia coli*—a story with no end?", FEMS Microbiology Letters, fnw256, 363(22):5 pages.
Budynek et al. (May 2010) "Bacteriophages and Cancer", Archives of Microbiology, 192(5):315-320.
Dabrowska et al. (2004) "Antitumor Activity of Bacteriophages in Murine Experimental Cancer Models Caused Possibly By Inhibition of [Beta]3 Integrin Signaling Pathway", Acta Virologica, 48(4):241-248.
Dabrowska et al. (2014) "Bacteriophages Displaying Anticancer Peptides in Combined Antibacterial and Anticancer Treatment", Future Microbiology, 9(7):861-869.
Dufour et al. (Nov. 1, 2016) "Bacteriophage LM33_P1, A Fast-acting Weapon Against The Pandemic ST131-025b:H4 *Escherichia Coli* Clonal Complex", J. Antimicrobial Chemotherapy, 71(11):3072-3080.
Dufour et al. (Jun. 1, 2017) "The Lysis of Pathogenic *Escherichia coli* by Bacteriophages Releases Less Endotoxin Than by β-Lactams", Clinical Infectious Diseases, 64(11):1582-1588.
Dufour et al. (Jun. 1, 2015) "Treatment of Highly Virulent Extraintestinal Pathogenic *Escherichia coli* Pneumonia With Bacteriophages", Critical Care Medicine, 43(6):29 pages.
Luo et al. (August, 2012) "Genome, Integration, and Transduction of a Novel Temperate Phage of Helicobacter pylori", Journal of Virology, 86(16):8781-8792.

(Continued)

*Primary Examiner* — Nicole Kinsey White
*Assistant Examiner* — Ruixue Wang
(74) *Attorney, Agent, or Firm* — Mintz, Levin, Cohn, Ferris, Glovsky and Popeo, P.C.

(57) ABSTRACT

The present invention relates to a bacteriophage composition comprising one or more (suitably two or more, or three) bacteriophages that target oncogenic (tumorigenic) bacteria, and use of the same for treating or preventing cancer.

24 Claims, 3 Drawing Sheets
Specification includes a Sequence Listing.

(56) References Cited

OTHER PUBLICATIONS

Uchiyama et al. (Mar. 8, 2013) "Characterization of Helicobacter pylori Bacteriophage KHP30", Applied and Environmental Microbiology, 79(10):3176-3184.

Eriksson, et al., Tumor-specific bacteriophages induce tumor destruction through activation of tumor-associated macrophages, Journal of Immunology, 2009, pp. 3105-3111, vol. 182, No. 5.

Golshahi, et al., In vitro lung delivery of bacteriophages KS4-M and ΦKZ using dry powder inhalers for treatment of Burkholderia cepacia complex and Pseudomonas aeruginosa infections in cystic fibrosis, Journal of Microbiology, 2010, pp. 106-117, vol. 110.

Hannigan, et al., Viral and Bacterial Communities of Colorectal Cancer, BioRxiv, 2017, 39 pages.

Jassim, et al., Natural solution to antibiotic resistance: bacteriophages 'The Living Drugs', World Journal of Microbiology and Biotechnology, 2014, pp. 2153-2170.

Kingwell, et al., Bacteriophage therapies re-enter clinical trials, 2015, pp. 515-516, vol. 14.

Malik, et al., Formulation, stabilization and encapsulation of bacteriophage for phage therapy, 2017, pp. 100-133, vol. 249.

Monk, et al., Bacteriophage applications: where are we now?, Letters in Applied Microbiology, 2010, pp. 363-369, vol. 51.

Pabary, et al., Antipseudomonal Bacteriophage Reduces Infective Burden and Inflammatory Response in Murine Lung, Antimicrobial Agents and Chemotherapy, 2016, pp. 744-751, vol. 60, No. 2.

Porayath, Characterization of the bacteriophages binding to human matrix molecules, International Journal of Biological Macromolecules, 2018, pp. 608-615, vol. 110.

\* cited by examiner

BACTERIOPHAGE FOR TREATMENT AND PREVENTION OF *E. COLI* AND *B. FRAGILIS* INFECTIONS

CROSS-REFERENCED APPLICATIONS

This application claims priority to U.S. Application No. 62/627,725 filed Feb. 7, 2018, the entirety of which is incorporated by reference herein.

SEQUENCE LISTING

The present disclosure contains a Sequence Listing, which has been submitted electronically in ASCII format and is hereby incorporated by reference in its entirety. The ASCII copy, created on Jan. 30, 2019, is named 054249-503001WO_Sequence_Listing_ST25 and is 1.24 megabytes in size.

FIELD

The present disclosure relates to compositions of bacteriophages, and use of the same for medical applications.

BACKGROUND

Bacterial pathogens can be associated with carcinogenesis/tumorigenesis in some tumors and/or tissues. Methods of treating or preventing cancer are needed.

SUMMARY OF THE INVENTION

The present disclosure relates to compositions and methods for treating or preventing a bacterial-associated cancer in a patient by administration of a bacteriophage composition. Preferably, the composition comprises at least one bacteriophage that targets the bacteria. The bacteriophage(s) may be specific for the bacteria or a strain (e.g., a pathogenic or carcinogenic strain) of the bacteria. Preferably, the composition minimizes development of bacterial resistance, e.g. by complementation. In some embodiments, the bacteriophages are lytic.

In an aspect, provided herein are methods for treating or preventing a bacterial-associated cancer in a patient in need thereof. The methods include administering to the patient a composition including one or more bacteriophages. In embodiments, the methods include selecting a patient with a confirmed bacterial-associated cancer. In embodiments, the bacteriophage target and lyse at least one bacterial species that is associated with cancer. In embodiments, each individual bacteriophage is not prone to generalized transduction and/or does not carry antibiotic resistance genes. In embodiments, one or more of the bacteriophages are not naturally occurring. The compositions as described herein have been shown to be efficacious in lysing bacteria associated with cancers (e.g., *E. coli*, *B. fragilis*). The bacteriophage composition can be an alternative to conventional antibacterial agents and/or cancer therapeutics, and overcomes one or more problems associated therewith. In embodiments, the bacteriophage composition can be utilized as co-treatment or in combination with conventional antibacterial agents and/or cancer therapeutics.

In an aspect, provided herein are methods for treating or preventing colorectal cancer in a patient in need thereof. In embodiments, the methods include administering to the patient a composition including one or more bacteriophages. In embodiments, the bacteriophages target at least one bacterial species that is associated with colorectal cancer. In embodiments, each individual bacteriophage is not prone to generalized transduction and/or does not carry antibiotic resistance genes. In embodiments, one or more of the bacteriophages are not naturally occurring. The compositions as described herein have been shown to be efficacious in lysing bacteria associated with colorectal cancers (e.g., *E. coli*, *B. fragilis*). The bacteriophage composition can be an alternative to conventional antibacterial agents and/or cancer therapeutics, and overcomes one or more problems associated therewith. In embodiments, the bacteriophage composition can be utilized as co-treatment or in combination with conventional antibacterial agents and/or cancer therapeutics.

In an aspect, provided herein are methods of modifying the microbial flora in a human including administering to said human a composition including one or more distinct bacteriophages having lytic activity against carcinogenic bacteria. The one or more distinct bacteriophages are selected from bacteriophages that infect *Escherichia coli*, *Bacteroides fragilis*, *Helicobacter pylori*, *Salmonella Typhi*, *Streptococcus bovis*, *Chlamydia pneumonia*, *mycoplasma*, *Helicobacter hepaticus*, and/or *Schistosoma haematobium*. In embodiments, one or more of the bacteriophage are not naturally occurring. In embodiments, the *E. coli* are positive carriers of the pks island (pks+*E. coli*). In some embodiments, the *B. fragilis* are enterotoxigenic *Bacteroides fragilis* (ETBF). The bacteriophage composition can be an alternative to conventional antibacterial agents and/or cancer therapeutics, and overcomes one or more problems associated therewith. In embodiments, the bacteriophage composition can be utilized as co-treatment or in combination with conventional antibacterial agents and/or cancer therapeutics.

In an aspect, provided herein are bacteriophage compositions including one or more obligately lytic bacteriophages that infect and lyse carcinogenic bacteria. In embodiments, the bacteriophages have a narrow spectrum of activity against the target bacterium. In embodiments, the composition is substantially free of bacterial components. In embodiments, each individual bacteriophage is not prone to generalized transduction and/or does not carry antibiotic resistance genes. In embodiments, one or more of the bacteriophages are not naturally occurring. The compositions as described herein have been shown to be efficacious in lysing bacteria associated with cancers. In embodiments, the bacteria species or strain targeted by the bacteriophages secrete a toxin that interferes with a eukaryotic cell cycle. In embodiments, the toxin is a cyclomodulin. In embodiments, the cyclomodulin is colibactin, a cyclomodulin synthesized by the pks genomic island in *E. coli*. In embodiments, the bacteria include species of *Escherichia*, *Bacteroides*, *Salmonella*, *Streptococcus*, *Chlamydia*, *mycoplasma*, *Helicobacter*, and/or *Campylobacter*. In embodiments, the bacteria species is *Escherichia coli*, *Bacteroides fragilis*, *Salmonella Typhi*, *Streptococcus bovis*, *Chlamydia pneumonia*, *Helicobacter pylori*, *Helicobacter hepaticus*, and/or *Campylobacter jejuni*. Preferably, the bacteria include *E. coli* and/or *B. fragilis*. In embodiments, the *E. coli* are pks+*E. coli*. In some embodiments, the *B. fragilis* is enterotoxigenic *Bacteroides fragilis* (ETBF). The bacteriophage composition can be an alternative to conventional antibacterial agents and/or cancer therapeutics, and overcomes one or more problems associated therewith. In embodiments, the bacteriophage composition can be utilized as co-treatment or in combination with conventional antibacterial agents and/or cancer therapeutics.

In an aspect, provided herein is a bacteriophage composition that includes one or more bacteriophages that target a carcinogenic bacteria, and a cryoprotectant. In embodiments, the composition is substantially free of bacterial components. In embodiments, each individual bacteriophage is not prone to generalized transduction and/or does not carry antibiotic resistance genes. In embodiments, one or more of the bacteriophages are not naturally occurring. The compositions as described herein have been shown to be efficacious in lysing bacteria associated with cancers. In embodiments, the bacteria species or strain targeted by the bacteriophages secrete a toxin that interferes with a eukaryotic cell cycle. In embodiments, the toxin is a cyclomodulin. In embodiments, the cyclomodulin is colibactin, a cyclomodulin synthesized by the pks genomic island in *E. coli*. In embodiments, the bacteria include species of *Escherichia, Bacteroides, Salmonella, Streptococcus, Chlamydia, mycoplasma, Helicobacter*, and/or *Campylobacter*. In embodiments, the bacteria species is *Escherichia coli, Bacteroides fragilis, Salmonella Typhi, Streptococcus bovis, Chlamydia pneumonia, Helicobacter pylori, Helicobacter hepaticus*, and/or *Campylobacter jejuni*. Preferably, the bacteria include *E. coli* and/or *B. fragilis*. In embodiments, the *E. coli* are pks+*E. coli*. In some embodiments, the *B. fragilis* is enterotoxigenic *Bacteroides fragilis* (ETBF). The bacteriophage composition can be an alternative to conventional antibacterial agents and/or cancer therapeutics, and overcomes one or more problems associated therewith. In embodiments, the bacteriophage composition can be utilized as co-treatment or in combination with conventional antibacterial agents and/or cancer therapeutics.

In an aspect, provided herein are bacteriophage compositions for use in treating a bacterial associated cancer in a subject. The methods include selecting a patient with a bacterial-associated cancer and administering a bacteriophage composition. In embodiments, the cancer may be any cancer that is caused by or associated with infection by a bacteria or bacteria strain. In embodiments, the bacterial-associated cancer is colorectal cancer, esophageal cancer, gallbladder cancer, lung cancer, squamous cell carcinoma, bladder cancer, stomach cancer, or mucosa-associated lymphoid tissue (MALT) lymphoma.

In an aspect, provided herein are uses of any composition described herein in the treatment of a confirmed bacterial-associated cancer. The uses include treatment of bacterial-associated cancer including administration to said human of a composition, the composition comprising at least one bacteriophage that targets and lyses a bacteria associated with cancer. In embodiments, the composition is substantially free of bacterial components. In embodiments, each individual bacteriophage is not prone to generalized transduction and/or does not carry antibiotic resistance genes. In embodiments, one or more of the bacteriophages are not naturally occurring. The compositions as described herein have been shown to be efficacious in lysing bacteria associated with cancers. In embodiments, the bacteria species or strain targeted by the bacteriophages secrete a toxin that interferes with a eukaryotic cell cycle. In embodiments, the toxin is a cyclomodulin. In embodiments, the cyclomodulin is colibactin, a cyclomodulin synthesized by the pks genomic island in *E. coli*. In embodiments, the bacteria include species of *Escherichia, Bacteroides, Salmonella, Streptococcus, Chlamydia, mycoplasma, Helicobacter*, and/or *Campylobacter*. In embodiments, the bacteria species is *Escherichia coli, Bacteroides fragilis*), *Salmonella Typhi, Streptococcus bovis, Chlamydia pneumonia, Helicobacter pylori, Helicobacter hepaticus*, and/or Campylobacterjejuni. Preferably, the bacteria include *E. coli* and/or *B. fragilis*. In embodiments, the *E. coli* are pks+*E. coli*. In some embodiments, the *B. fragilis* is enterotoxigenic *Bacteroides fragilis* (ETBF). The bacteriophage composition can be an alternative to conventional antibacterial agents and/or cancer therapeutics, and overcomes one or more problems associated therewith. In embodiments, the bacteriophage composition can be utilized as co-treatment or in combination with conventional antibacterial agents and/or cancer therapeutics.

In an aspect, provided herein is a kit that includes a bacteriophage composition and instructions for use of the same.

DETAILED DESCRIPTION

Figure 1:
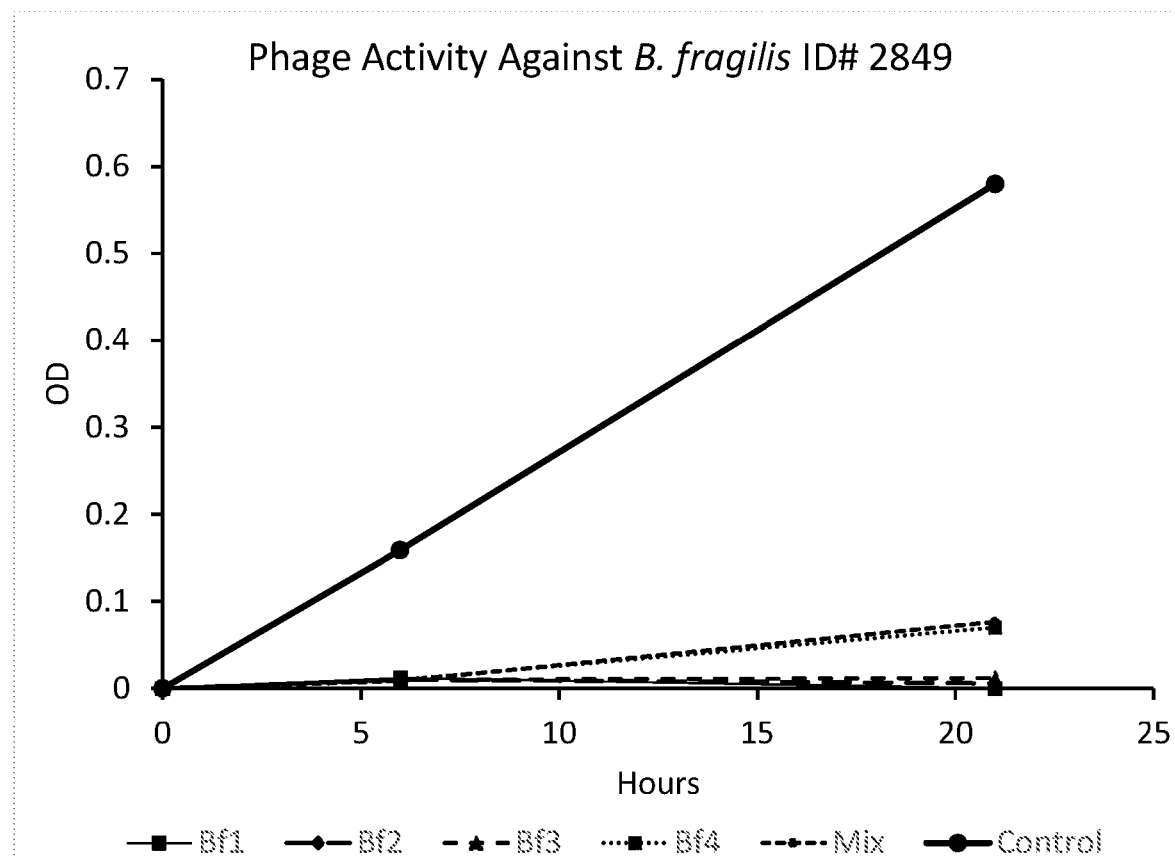
FIG. 1 is a graph of phage activity of four different phage and a mixture of phage against a *Bacteroides fragilis* strain (Clindamycin resistant).

The invention is predicated upon the surprising finding by the present inventors that a bacteriophage composition comprising one or more (preferably at least two) bacteriophages selected from phages that infect and lyse carcinogenic bacteria, or mutants thereof, is particularly advantageous for use in both medical and non-medical applications such as a rapid companion diagnostic, and particularly for treating a bacterial associated cancer in a subject.

It is to be understood that the present disclosure is not limited to particular embodiments described, as such may, of course, vary. It is also to be understood that the terminology used herein is for describing particular embodiments only, and is not intended to be limiting, since the scope of the present disclosure will be limited only by the appended claims.

The detailed description of the present disclosure is divided into various sections only for the reader's convenience and disclosure found in any section may be combined with that in another section. Unless defined otherwise, all technical and scientific terms used herein have the same meaning as commonly understood by one of ordinary skill in the art to which the present disclosure belongs.

Definitions

It must be noted that as used herein and in the appended claims, the singular forms "a," "an," and "the" include plural referents unless the context clearly dictates otherwise. Thus, for example, reference to "a bacteriophage composition" includes a plurality of such candidate agents and reference to "the bacteriophage" includes reference to one or more bacteriophages and equivalents thereof known to those skilled in the art, and so forth.

As used herein, the term "about" when used before a numerical designation, e.g., temperature, time, amount, concentration, and such other, including a range, indicates approximations which may vary by (+) or (−) 10%, 5%, or 1%.

When a range (e.g., dosage range) is listed herein, it is to be understood that the value may include any value or range within the recited range(s), including endpoints.

The term "mutant" as used herein refers to a bacteriophage differing genetically from a particular bacteriophage by one or more nucleotides while retaining the ability to infect and lyse target bacteria. Mutants typically comprise e.g., silent mutations, conservative mutations, minor deletions, and/or minor replications of genetic material, and retain phenotypic characteristics of the reference bacteriophage. In a preferred embodiment, the mutants of the invention retain any observable characteristic or property that is dependent upon the genome of the bacteriophage of the invention, i.e. phenotypic characteristics of said bacteriophage and/or activity against the bacteria strains. Preferred mutants have less than 5% nucleic acid variation as compared to the genome of the reference bacteriophage, even more preferably less than 4%, more preferably less than 2%. Alternatively, or in combination, mutants have preferably less than 5% amino acid variation in a coded polypeptide sequence as compared to a polypeptide of the reference bacteriophage.

The term "% identity" or "% sequence identity" in relation to nucleic acid or amino acid sequences designates the level of identity or homology between said sequences and may be determined by techniques known per se in the art. Any of a variety of sequence alignment methods can be used to determine percent identity, including, without limitation, global methods, local methods and hybrid methods, such as segment approach methods. Protocols to determine percent identity are routine procedures within the scope of one skilled in the art. Global methods align sequences from the beginning to the end of the molecule and determine the best alignment by adding up scores of individual nucleotide pairs and by imposing gap penalties. Non-limiting methods include, e.g., CLUSTAL W, see, e.g., Julie D. Thompson et al., CLUSTAL W: Improving the Sensitivity of Progressive Multiple Sequence Alignment Through Sequence Weighting, Position-Specific Gap Penalties and Weight Matrix Choice, 22(22) *Nucleic Acids Research* 4673-4680 (1994); and iterative refinement. Non-limiting methods include, e.g., BLAST, Match-box, see, e.g., Align-M, see, e.g., Ivo Van Walle et al., Align-M—A New Algorithm for Multiple Alignment of Highly Divergent Sequences, 20(9) *Bioinformatics* 1428-1435 (2004).

The term "complementation" as used herein refers to the ability of a bacteriophage with a particular genome to compensate for a different, distinct bacteriophage with a different genome. More specifically, bacteriophage insensitive mutant colonies (of target bacteria) may arise to a particular bacteriophage but may still be sensitive to a different bacteriophage. In other words, bacteriophage-resistant mutant bacteria arising to one phage are still sensitive to another phage.

The term "generalized transduction" as used herein refers to the process by which bacterial DNA may be transferred to another bacterium via a bacteriophage. It is a rare event; a very small percentage of phage particles happen to carry a donor bacterium's DNA, on the order of 1 phage in 10,000. In essence, this is the packaging of bacterial DNA into a viral capsid.

The term "lytic" or "lytic activity" designates the property of a bacteriophage to cause lysis of a bacterial cell. The lytic activity of a bacteriophage can be tested on bacteria (e.g., *E. coli* strains) according to techniques known in the art. The lytic cycle is named for the process that occurs when a phage has infected a cell, replicated new phage particles, and bursts through the host cell wall and membrane(s). Some phage exhibit a lysogenic cycle during which the bacteriophage DNA remains practically dormant due to active repression of bacteriophage processes. Whenever the bacteria divides, the DNA of the phage is copied as well. In this way, the virus can continue existing within its host without lysing the host. At a certain point, conditions may change and the phage enters a lytic cycle. "Obligately lytic" refers to phage that are unable to undergo a lysogenic cycle.

Non-limiting examples of *E. coli* bacteriophages include EC200pp (Bolocan et al, FEMS Microbiology Letters, Vol. 363, Issue 22, Nov. 1, 2016), LM33-P1 (Dufour et al, J. Antimicrobial Chemotherapy, Vol. 71, Issue 11, Nov. 1, 2016, p 3072-3080), 536_P1 (Dufour et al, Clinical Infectious Diseases, Vol. 64, Issue 11, June 2017, p 1589-1590), 536_P7 (Dufour et al, Critical Care Medicine, 43(6):e190-e198, June 2015), T4, Lamda Argo2, Lambda Argo 1, T3, P1, PR722, Ox6, Lamda W60, rEDb44, r1589, T6, rA105, r71, UV1, 49B, BG3, 53 alpha, rEDb50, 221, Phi X174, 184, rH23, r638, r187, rJ3, rED220, FCZ, r196, rEDb45, rH88, 547, C204, 24B, 6C, rEDa41, UV47, G178, C33, T2, and T1 (ATCC collection). Non-limiting examples of *Bacteroides fragilis* bacteriophages include B40-8 (RefSeq: NC_011222), B124-14 (RefSeq: NC_016770), 51477-B1 (ATCC.org). Non-limiting examples of *Salmonella Typhi* bacteriophages include phSE-1, phSE-2, phSE-5 (Pereira et al, Virus Res., 2016 Jul. 15; 220:179-92). Non-limiting examples of *Streptococcus bovis* bacteriophages include the phages isolated and characterized by Iverson et al (Iverson et al, Canadian Journal of Microbiology, 1976, 22(6):847-852). Non-limiting examples of *Chlamydia pneumonia* bacteriophages include φCPAR39 (Hoestgaard-Jensen et al, FEMS Immunology & Medical Microbiology, Vol. 62, Issue 2, Jul. 1, 2011, p 148-156). Non-limiting examples of *Helicobacter* bacteriophages include KHP30 (Uchiyama et al, Appl. Environ. Microbiol. April 2013, 79(10) 3176-3184), HP1 (Heintschel et al, J. Med. Microbiol., Apr. 1, 1993, 38:245-249), 1961P (Luo et al, Journal of Virology, July 2012, 86 (16) 8781-8792). Non-limiting examples of *Campylobacter jejuni* bacteriophages include CP8 and CP34 (Loc Carrillo et al, Appl. Environ. Microbiol., November 2005, 71(11) 6554-6563), c/958 (Ritchie et al, J. Med. Microbiol., Vol 16, 1983, 333-340), phages 1-14 identified by Grajewski et al (Grajewski et al, Journal of Clinical Microbiology, July 1985, p 13-18). In embodiments, compositions and methods provided herein exclude one or more bacteriophage described herein.

The term "treat" or "treating" as used herein is intended to encompass prophylactic treatment as well as corrective treatment (treatment of a subject already suffering from a disease). Treating may also refer to treating one or more symptoms of a disease or disorder, as well as slowing or stopping progression of the disease or disorder.

The term "prevent" or "preventing" as used herein is intended to encompass preventing a disease or disorder (e.g., cancer) from occurring in a patient or patient population, as well as reducing the occurrence of the disease or disorder, slowing/prolonging the onset of the disease or disorder, and the like.

The term "bacterial-associated cancer," "carcinogenic bacteria," and "tumorigenic bacteria" refer to infectious organisms that are known or suspected to cause cancer. While cancer-associated bacteria have been considered to be opportunistic (i.e., infecting healthy tissues after cancer has already established itself), there is evidence that bacteria may be directly carcinogenic. The complex relationship between bacteria and humans is demonstrated by *Helico-*

*bacter pylori* and *Salmonella Typhi* infections. Research has shown that *H. pylori* can cause gastric cancer or MALT lymphoma in some individuals. *Salmonella Typhi* infection has been associated with the development of gallbladder cancer. Many species, however, share an important characteristic: highly site-specific colonization.

A use or method of the invention typically comprises administering a bacteriophage composition described herein to a subject or patient. As used herein, a "subject" or "patient" is a mammal, such as a human or other animal. Preferably, the subject or patient is a human. Preferably, the subject or patient is in need of treatment with the composition as described herein, e.g., has a bacterial infection susceptible to treatment with the composition.

The term "isolated" as used herein indicates that the bacteriophage is removed from the environment in which it naturally occurs. In particular, an isolated bacteriophage is, e.g., cultivated, cultured separately from the environment in which it is naturally located. Some aspects herein relate to isolated bacteriophage (individually and/or collectively), compositions of the same, and methods of using the same to treat bacteria associated cancers. The isolated bacteriophage include, but are not limited to, those specifically described and listed herein.

The term "purified" as used herein indicates that the bacteriophage are removed from manufacturing host bacteria. In particular, a purified bacteriophage has production impurities, such as bacterial components, removed from its manufacturing or production environment. Bacterial components include but are not limited to bacterial host proteins, lipids, and/or bacterial endotoxin. The term "purified" may also refer to genetic purification in which the strain of bacteriophage is genetically homogenous. Some aspects herein relate to purified bacteriophage (individually and/or collectively), compositions of the same, and methods of using the same to treat bacteria associated cancers. The purified bacteriophage include, but are not limited to, those specifically described and listed herein.

As used herein, the term "substantially purified" refers to a composition containing less than 1%, less than 0.1%, less than 0.001%, or no detectable amount of contaminants such as host bacterial proteins or endotoxin. Also, as used herein, the term "substantially pure" when used to describe a bacteriophage strain refers to the genetic purity of the composition such that the consensus sequence of each phage within the composition is greater than 99%, greater than 99.9%, greater than 99.999%, or 100% identical to the expected nucleic acid sequence for that phage. Some aspects herein relate to substantially purified bacteriophage (individually and/or collectively), compositions of the same, and methods of using the same to treat bacteria associated cancers. The substantially purified bacteriophage include, but are not limited to, those specifically described and listed herein.

Typically, a composition is substantially pure when at least 80%, more preferably at least 85%, more preferably at least 90%, more preferably at least 95%, more preferably at least 98%, and most preferably at least 99% of the total material (by volume, by wet or dry weight, or by mole percent or mole fraction) in a sample is free of impurities and/or genetic variants.

The term "substantially free" as used herein can refer to something having less than 10% of the substance that it is to be free from. For example, 0.01% to 10% free, including any subvalue and subrange therein, including endpoints. For example, 0.01, 0.02, 0.03, 0.04, 0.05, 0.06, 0.07, 0.08, 0.09, 1, 2, 3, 4, 5, 6, 7, 8, 9, or 10%.

A "synergistic amount" as used herein refers to the sum of a first amount (e.g., a bacteriophage) and a second amount (e.g., a different bacteriophage) that results in a synergistic effect (i.e. an effect greater than an additive effect). Therefore, the terms "synergy", "synergism", "synergistic", "combined synergistic amount", and "synergistic therapeutic effect" which are used herein interchangeably, refer to a measured effect of the compound administered in combination where the measured effect is greater than the sum of the individual effects of each of the compounds provided herein administered alone as a single agent.

The term "consists essentially of" as used herein means that only the bacteriophage(s) explicitly indicated are present in the bacteriophage composition, but that said composition may also contain a further non-bacteriophage constituent, such as an appropriate carrier, diluent, antibiotic (e.g., chemical antibiotic), etc.

Additional terms and phrases are defined below.

Bacteriophage Compositions

Provided herein are bacteriophage compositions, including compositions that are substantially free of bacterial components such as for example bacterial endotoxins, bacterial host protein, and the like. The compositions can include one or more obligately lytic bacteriophages and optionally a cryoprotectant. The bacteriophage can be any phage as described herein, and may include at least one phage with a nucleic acid sequence or a genome including a nucleotide sequence having at least 90% identity to any one of SEQ ID NO: 1-6. The bacteriophage can be any phage as described herein, and may include at least one phage with a nucleic acid sequence or a genome including a nucleotide sequence having at least 90% identity to the genomic sequence of deposited strain Bf1 (Accession No. 040219-02), Bf2 (Accession No. 040219-03), Bf3 (Accession No. 040219-04), and/or Bf4 (Accession No. 040219-05) deposited at the Canadian Science Centre for Human and Animal Health. In some aspects at least one of the bacteriophage do not have 100% identity to one or more of SEQ ID NO: 1, SEQ ID NO: 2, SEQ ID NO: 3, SEQ ID NO: 4, SEQ ID NO: 5, SEQ ID NO: 6. In some aspects at least one of the bacteriophage do not have 100% identity to one or more of the genomic sequence of deposited strain Bf1 (Accession No. 040219-02), Bf2 (Accession No. 040219-03), Bf3 (Accession No. 040219-04), and/or Bf4 (Accession No. 040219-05) deposited at the Canadian Science Centre for Human and Animal Health (International Depository of Canada). In some aspects one or more of the bacteriophage are non-naturally occurring. In some aspects, an individual bacteriophage is not prone to generalized transduction and/or does not carry antibiotic resistance genes. In embodiments, compositions and methods provided herein exclude one or more bacteriophage described herein.

Provided herein are bacteriophage compositions including one or more bacteriophage that infect and lyse carcinogenic bacteria. In embodiments, the bacteriophage have a narrow spectrum of action against the target bacterium. In embodiments, one or more of the bacteriophage are not naturally occurring. In embodiments, the composition is substantially free of bacterial components. In embodiments, each individual bacteriophage is not prone to generalized transduction and/or does not carry antibiotic resistance genes.

In embodiments, the bacteriophage differ in nucleotide or genomic sequence by up to about 15%, up to about 14%, up to about 13%, up to about 12%, up to about 11%, up to about 10%, up to about 9%, up to about 8%, up to about 7%, up to about 6%, up to about 5%, up to about 4%, up to about 3%, up to about 2%, or up to about 1% compared to the genomic sequence of *E. coli* phage Ec20 (SEQ ID NO: 1), Ec34 (SEQ ID NO: 2), Ec35 (SEQ ID NO: 3), Ec45 (SEQ ID NO: 4), Ec56 (SEQ ID NO: 5) and/or Ec57 (SEQ ID NO: 6). In embodiments, the bacteriophage differ in nucleotide or genomic sequence by up to about 15%, up to about 14%, up to about 13%, up to about 12%, up to about 11%, up to about 10%, up to about 9%, up to about 8%, up to about 7%, up to about 6%, up to about 5%, up to about 4%, up to about 3%, up to about 2%, or up to about 1% compared to the genomic sequence of *B. fragilis* phage Bf1 (Accession No. 040219-02), Bf2 (Accession No. 040219-03), Bf3 (Accession No. 040219-04), and/or Bf4 (Accession No. 040219-05) deposited at the Canadian Science Centre for Human and Animal Health (International Depository of Canada).

The compositions as described herein have been shown to be particularly useful in for treating bacterial infections, in particular bacteria associated with cancers. As used herein, the terms "oncogenic bacteria", "tumorigenic bacteria", and "bacteria associated with cancers" are used interchangeable. In embodiments, the bacteriophages precisely target the tumorigenic bacteria without broadly destroying microbiota (e.g., other bacteria and/or microbes) present in the patient. In embodiments, the bacteriophages are specific for tumorigenic bacteria and do not target other microorganisms.

In embodiments, the bacteria include *Escherichia coli, Bacteroides* species (e.g., *Bacteroides fragilis*), *Salmonella Typhi, Streptococcus bovis, Chlamydia pneumonia, mycoplasma, Helicobacter* species (e.g., *Helicobacter pylori, Helicobacter hepaticus*), and/or *Campylobacter jejuni*. In embodiments, the bacteria include *E. coli* and/or *B. fragilis*. In embodiments, the *E. coli* are pks+*E. coli*. In some embodiments, the *B. fragilis* are enterotoxigenic *Bacteroides fragilis* (ETBF). In one embodiment, the *B. fragilis* is a Clindamycin resistant strain. In one embodiment, the *B. fragilis* is a Clindamycin sensitive strain. In embodiments, the bacteria species or strain targeted by the bacteriophages secrete a toxin that interferes with a eukaryotic cell cycle. In embodiments, the toxin is a cyclomodulin. In embodiments, the cyclomodulin is colibactin, a cyclomodulin synthesized by the pks genomic island in *E. coli*.

In embodiments, the bacteriophage composition includes at least one, at least two, at least three, or at least four bacteriophages such that the composition is effective against at least about 60% of target bacterial strains. For example, the bacteriophage composition is effective against (e.g., kills or lyses) at least 60% of *E. coli* and/or *B. fragilis* strains in a given panel. In one embodiment, the bacteriophage composition includes at least one, at least two, at least three, or at least four bacteriophages such that the composition is effective against at least about 70% of target bacterial strains. In one embodiment, the bacteriophage composition includes at least one, at least two, at least three, or at least four bacteriophages such that the composition is effective against at least about 75% of target bacterial strains. In one embodiment, the bacteriophage composition includes at least one, at least two, at least three, or at least four bacteriophage such that the composition is effective against at least about 76% of target bacterial strains. In one embodiment, the bacteriophage composition includes at least one, at least two, at least three, or at least four bacteriophages such that the composition is effective against at least about 77% of target bacterial strains. In one embodiment, the bacteriophage composition comprises at least one, at least two, at least three, or at least four bacteriophages such that the composition is effective against at least about 78% of target bacterial strains. In one embodiment, the bacteriophage composition includes at least one, at least two, at least three, or at least four bacteriophages such that the composition is effective against at least about 79% of target bacterial strains. In one embodiment, the bacteriophage composition includes at least one, at least two, at least three, or at least four bacteriophages such that the composition is effective against at least about 80% of target bacterial strains. In one embodiment, the bacteriophage composition includes at least one, at least two, at least three, or at least four bacteriophages such that the composition is effective against at least about 81% of target bacterial strains. In one embodiment, the bacteriophage composition includes at least one, at least two, at least three, or at least four bacteriophages such that the composition is effective against at least about 82% of target bacterial strains. In one embodiment, the bacteriophage composition includes at least one, at least two, at least three, or at least four bacteriophage such that the composition is effective against at least about 83% of target bacterial strains. In one embodiment, the bacteriophage composition includes at least one, at least two, at least three, or at least four bacteriophages such that the composition is effective against at least about 84% of target bacterial strains. In one embodiment, the bacteriophage composition includes at least one, at least two, at least three, or at least four bacteriophage such that the composition is effective against at least about 85% of target bacterial strains. In one embodiment, the bacteriophage composition includes at least one, at least two, at least three, or at least four bacteriophage such that the composition is effective against at least about 90% of target bacterial strains. In another embodiment, the bacteriophage composition includes at least one, at least two, at least three, or at least four bacteriophages such that the composition is effective against one or more bacterial strains (or isolates) from a subject with a bacterial infection.

In embodiments, the bacteria or bacteria strain targeted by the bacteriophages are associated with cancer. In embodiments, the bacteria species or strain targeted by the bacteriophages secrete a toxin that interferes with a eukaryotic cell cycle. In embodiments, the toxin is a cyclomodulin. In embodiments, the cyclomodulin is colibactin, a cyclomodulin synthesized by the pks genomic island in *E. coli*. In embodiments, the bacteria include *Escherichia coli, Bacteroides* species (e.g., *Bacteroides fragilis*), *Salmonella Typhi, Streptococcus bovis, Chlamydia pneumonia, mycoplasma, Helicobacter* species (e.g., *Helicobacter pylori, Helicobacter hepaticus*), and/or *Campylobacter jejuni*. Preferably, the bacteria include *E. coli* and/or *B. fragilis*. In embodiments, the *E. coli* are pks+*E. coli*. In some embodiments, the *B. fragilis* are enterotoxigenic *Bacteroides fragilis* (ETBF). In one embodiment, the *B. fragilis* is a Clindamycin resistant strain. In one embodiment, the *B. fragilis* is a Clindamycin sensitive strain.

In embodiments, the bacteriophage compositions comprise at least one bacteriophage that targets an oncogenic bacteria or bacterial strain, or mutants of such bacteriophages. In one embodiment, a bacteriophage composition comprises at least two bacteriophages or mutants thereof. In one embodiment, a bacteriophage composition comprises at least three bacteriophages or mutants thereof. In one embodiment, the bacteriophage composition comprises one or more additional bacteriophages, for example one or more additional bacteriophages that target a different bacteria or bacteria strain. In a preferred embodiment, the one or more additional bacteriophages are suitable for treating an oncogenic bacterial infection.

The bacteriophages may be of any type that are capable of infecting/targeting the target bacterial strain or species. In embodiments, the bacteriophages are capable of lysing the target bacterial species or strain.

In embodiments (alternatively or additionally), a "mutant" bacteriophage is capable of lysing the same target bacterial strains as the parent bacteriophage, and further capable of lysing one or more additional bacterial strains. In one embodiment a mutant may have at least 75%, 80%, 85%, 86%, 87%, 88%, 89%, 90%, 91%, 92%, 93%, 94%, 95%, 96%, 97%, 98%, or 99% sequence identity across its entire genome when compared to the parent bacteriophage.

In embodiments, the bacteriophage composition targets one or more *Escherichia* species. In embodiments, the bacteriophage composition targets one or more *E. coli* strains (e.g., one or more oncogenic *E. coli* strains). In one embodiment, an *E. coli* strain targeted is a colibactin-producing strain. In one embodiment, an *E. coli* strain targeted is a pks+*E. coli* strain. See, for example, Dejea et al., Science 359, 592-597 (2018), which is incorporated herein by reference in its entirety. In embodiments, the composition includes one or more bacteriophage selected from Ec20, Ec34, Ec35, Ec45, Ec56, and Ec57. In embodiments, the composition includes two bacteriophage selected from Ec20, Ec34, Ec35, Ec45, Ec56, and Ec57. In embodiments, the composition includes three bacteriophage selected from Ec20, Ec34, Ec35, Ec45, Ec56, and Ec57. In embodiments, the composition includes four bacteriophage selected from Ec20, Ec34, Ec35, Ec45, Ec56, and Ec57. In embodiments, the composition includes five bacteriophage selected from Ec20, Ec34, Ec35, Ec45, Ec56, and Ec57. In embodiments, the composition includes six bacteriophage selected from Ec20, Ec34, Ec35, Ec45, Ec56, and Ec57. In one embodiment, the bacteriophage are Ec34 (Accession No. 040219-07), Ec35 (Accession No. 040219-08), Ec45 (Accession No. 040219-09), and Ec57 (Accession No. 040219-10) deposited at the Canadian Science Centre for Human and Animal Health (International Depository of Canada). In one embodiment, the bacteriophage are Ec34 (Accession No. 040219-07), Ec35 (Accession No. 040219-08), and Ec57 (Accession No. 040219-10) deposited at the Canadian Science Centre for Human and Animal Health (International Depository of Canada). In embodiments, compositions provided herein exclude one or more bacteriophage described herein.

In embodiments, the bacteriophage composition targets one or more *Bacteroides* species. In embodiments, the bacteriophage composition targets one or more *B. fragilis* strains (e.g., one or more oncogenic *B. fragilis* strains). In one embodiment, a *B. fragilis* strain targeted is a *Bacteroides fragilis* toxin (bft)-producing strain. In one embodiment, the *Bacteroides fragilis* strain targeted is an enterotoxigenic *Bacteroides fragilis* (ETBF) strain. In one embodiment, the *B. fragilis* is a Clindamycin resistant strain. In one embodiment, the *B. fragilis* is a Clindamycin sensitive strain. In embodiments, provided herein are bacteriophages known to target *Bacteroides fragilis* including Bf1 (Accession No. 040219-02), Bf2 (Accession No. 040219-03), Bf3 (Accession No. 040219-04), and/or Bf4 (Accession No. 040219-05) deposited at the Canadian Science Centre for Human and Animal Health (International Depository of Canada). In embodiments, the composition includes one or more bacteriophage selected from Bf1, Bf2, Bf3, and Bf4. In embodiments, the composition includes two bacteriophage selected from Bf1, Bf2, Bf3, and Bf4. In embodiments, the composition includes three bacteriophage selected from Bf1, Bf2, Bf3, and Bf4. In embodiments, the composition includes bacteriophage Bf1, Bf2, Bf3, and Bf4. In embodiments, compositions provided herein exclude one or more bacteriophage described herein.

In one embodiment, the bacteriophage composition targets one or more *Salmonella* species. In one embodiment, the bacteriophage composition targets one or more *Salmonella Typhi* strains. In embodiments, provided herein are bacteriophages known to target *Salmonella Typhi* including bacteriophage phSE-1, phSE-2, and phSE-5. In embodiments, compositions provided herein exclude one or more bacteriophage described herein.

In embodiments, the bacteriophage composition targets one or more *Streptococcus* species. In embodiments, the bacteriophage composition targets one or more *Streptococcus bovis* strains. In embodiments, provided herein are bacteriophages known to target *Streptococcus bovis* including the phages isolated and characterized by Iverson et al (Iverson et al, Canadian Journal of Microbiology, 1976, 22(6):847-852). In embodiments, compositions provided herein exclude one or more bacteriophage described herein.

In embodiments, the bacteriophage composition targets one or more *Chlamydia* species. In one embodiment, the bacteriophage composition targets one or more *Chlamydia* pneumonia strains. In embodiments, provided herein are bacteriophages known to target *Chlamydia* pneumonia including bacteriophage φCPAR39. In embodiments, compositions provided herein exclude one or more bacteriophage described herein.

In embodiments, the bacteriophage composition targets one or more *mycoplasma* species e.g. *M. hominis, M. genitalium, M. fermentans,* M. pneuomonia, and *M. mycoides*. In embodiments, the bacteriophage composition targets one or more *mycoplasma* strains. In embodiments, provided herein are bacteriophages known to target *mycoplasma*, including bacteriophage phiMFV1 and MAV1. In embodiments, compositions provided herein exclude one or more bacteriophage described herein.

In embodiments, the bacteriophage composition targets one or more *Helicobacter* species (e.g., *Helicobacter pylori, Helicobacter hepaticus*). In embodiments, the bacteriophage composition targets one or more *Helicobacter pylori* strains. In embodiments, the bacteriophage composition targets one or more *Helicobacter hepaticus* strains. In embodiments, provided herein are bacteriophages known to target *Helicobacter* including bacteriophage KHP30, HP1, and 1961P. In embodiments, compositions provided herein exclude one or more bacteriophage described herein.

In embodiments, the bacteriophage composition targets one or more *Campylobacter* species. In embodiments, the bacteriophage composition targets one or more *Campylobacter jejuni* strains. In embodiments, provided herein are bacteriophages known to target *Campylobacter jejuni* including bacteriophage CP8, CP34, and c/958. In embodiments, compositions provided herein exclude one or more bacteriophage described herein.

The bacteriophages Ec34 (Accession No. 040219-07), Ec35 (Accession No. 040219-08), Ec45 (Accession No. 040219-09), and Ec57 (Accession No. 040219-10) were deposited at the Canadian Science Centre for Human and Animal Health (International Depository of Canada). All of the deposits were made under the provisions of the Budapest Treaty on the International Recognition of the Deposit of Microorganisms for the Purposes of Patent Procedure.

The bacteriophages Bf1 (Accession No. 040219-02), Bf2 (Accession No. 040219-03), Bf3 (Accession No. 040219-04), and/or Bf4 (Accession No. 040219-05) deposited at the Canadian Science Centre for Human and Animal Health (International Depository of Canada). All of the deposits were made under the provisions of the Budapest Treaty on the International Recognition of the Deposit of Microorganisms for the Purposes of Patent Procedure.

In embodiments, compositions provided herein include one or more bacteriophage selected from Ec20, Ec34, Ec35, Ec45, Ec56, Ec57, Bf1, Bf2, Bf3, and Bf4. In embodiments, the composition includes two bacteriophage selected from Ec20, Ec34, Ec35, Ec45, Ec56, Ec57, Bf1, Bf2, Bf3, and Bf4. In embodiments, the composition includes three bacteriophage selected from Ec20, Ec34, Ec35, Ec45, Ec56, Ec57, Bf1, Bf2, Bf3, and Bf4. In embodiments, the composition includes four bacteriophage selected from Ec20, Ec34, Ec35, Ec45, Ec56, Ec57, Bf1, Bf2, Bf3, and Bf4. In embodiments, the composition includes five bacteriophage selected from Ec20, Ec34, Ec35, Ec45, Ec56, Ec57, Bf1, Bf2, Bf3, and Bf4. In embodiments, the composition includes six bacteriophage selected from Ec20, Ec34, Ec35, Ec45, Ec56, Ec57, Bf1, Bf2, Bf3, and Bf4. In embodiments, the composition includes seven bacteriophage selected from Ec20, Ec34, Ec35, Ec45, Ec56, Ec57, Bf1, Bf2, Bf3, and Bf4. In embodiments, the composition includes eight bacteriophage selected from Ec20, Ec34, Ec35, Ec45, Ec56, Ec57, Bf1, Bf2, Bf3, and Bf4. In embodiments, the composition includes nine bacteriophage selected from Ec20, Ec34, Ec35, Ec45, Ec56, Ec57, Bf1, Bf2, Bf3, and Bf4. In embodiments, the composition includes ten bacteriophage selected from Ec20, Ec34, Ec35, Ec45, Ec56, Ec57, Bf1, Bf2, Bf3, and Bf4. In embodiments, the composition includes Ec34, Ec35, Ec45, Ec57, Bf1, Bf2, Bf3, and Bf4. In embodiments, compositions provided herein exclude one or more bacteriophage described herein.

The bacteriophages of a composition of the invention may be provided in the form of a single therapeutic composition (preferred) or as a number of separate compositions each comprising one or more members of the composition. In embodiments where the bacteriophages are provided in a number of separate compositions, said bacteriophages may be administered to a subject sequentially or simultaneously.

In embodiments where more than one bacteriophage is present in the bacteriophage composition, the composition is formulated such that each bacteriophage may be present at a ratio of between 1:10 and 10:1 (or any sub value or subrange there between including the endpoints) compared to the amount (e.g., concentration) of any other bacteriophage in the composition. In embodiments, each bacteriophage is present at a ratio of about 1:1 compared to one or more other bacteriophages in the composition. In embodiments, each bacteriophage is present at a ratio of about 1:2 compared to one or more other bacteriophages in the composition. In embodiments, each bacteriophage is present at a ratio of about 1:3 compared to one or more other bacteriophages in the composition. In embodiments, each bacteriophage is present at a ratio of about 1:4 compared to one or more other bacteriophages in the composition. In embodiments, each bacteriophage is present at a ratio of about 1:5 compared to one or more other bacteriophages in the composition. In embodiments, each bacteriophage is present at a ratio of about 1:6 compared to one or more other bacteriophages in the composition. In embodiments, each bacteriophage is present at a ratio of about 1:7 compared to one or more other bacteriophages in the composition. In embodiments, each bacteriophage is present at a ratio of about 1:8 compared to one or more other bacteriophages in the composition. In embodiments, each bacteriophage is present at a ratio of about 1:9 compared to one or more other bacteriophages in the composition. In embodiments, each bacteriophage is present at a ratio of about 1:10 compared to one or more other bacteriophages in the composition. In embodiments, each bacteriophage is present at a ratio of about 10:1 compared to one or more other bacteriophages in the composition. In embodiments, each bacteriophage is present at a ratio of about 5:1 compared to one or more other bacteriophages in the composition. In embodiments, each bacteriophage is present at a ratio of about 10:3 compared to one or more other bacteriophages in the composition. In embodiments, each bacteriophage is present at a ratio of about 5:2 compared to one or more other bacteriophages in the composition. In embodiments, each bacteriophage is present at a ratio of about 2:1 compared to one or more other bacteriophages in the composition. In embodiments, each bacteriophage is present at a ratio of about 5:3 compared to one or more other bacteriophages in the composition. In embodiments, each bacteriophage is present at a ratio of about 10:7 compared to one or more other bacteriophages in the composition. In embodiments, each bacteriophage is present at a ratio of about 5:4 compared to one or more other bacteriophages in the composition.

A bacteriophage for inclusion in a composition may be propagated by any suitable method known in the art. For example, one or more bacteriophage(s) may be grown separately in host bacterial strains capable of supporting growth of the bacteriophage. Typically, the bacteriophage will be grown in said host bacterial strain to high concentrations, titrated and combined to form the composition. The amount of each bacteriophage employed (e.g., in a bacteriophage composition, method or use) will depend upon its virulence against the target bacterial species.

The amount of each bacteriophage employed (e.g. in a bacteriophage composition, method or use as described herein) may depend upon its virulence against the target bacterial isolate.

Pre-selected or baseline bacterial strains may be used in the development of a composition, i.e., bacterial strains which are indicators for individual prospective members of the composition (e.g. panel). A preselected or baseline strain may permit at least 1000 times more plaque formation by one prospective member of the bacteriophage composition than another may. In this way, a composition (e.g. panel) that is consistently effective against a wide range of bacterial isolates may be achieved.

Typically, the one or more bacteriophage(s) may be combined to form a composition including at least about $1\times10^5$, $1\times10^6$, $1\times10^7$, $1\times10^8$, $1\times10^9$ or $1\times10^{10}$, or $1\times10^{11}$ plaque forming units (PFU) of each phage per mL of composition. The composition may include $1\times10^5$ to $1\times10^{11}$ PFU of each phage per mL of composition. In embodiments, the composition may include $1\times10^5$ to $1\times10^6$ PFU, $1\times10^5$ to $1\times10^7$ PFU, $1\times10^5$ to $1\times10^8$ PFU, $1\times10^5$ to $1\times10^9$ PFU, or $1\times10^5$ to $1\times10^{10}$ PFU of each phage per mL of composition. In embodiments, the composition may include $1\times10^6$ to $1\times10^7$ PFU, $1\times10^6$ to $1\times10^8$ PFU, $1\times10^6$ to $1\times10^9$ PFU, $1\times10^6$ to $1\times10^{10}$ PFU, or $1\times10^6$ to $1\times10^{11}$ PFU of each phage per mL of composition. In embodiments, the composition may include $1\times10^7$ to $1\times10^8$ PFU, $1\times10^7$ to $1\times10^9$ PFU, $1\times10^7$ to $1\times10^{10}$ PFU, or $1\times10^7$ to $1\times10^{11}$ PFU of each phage per mL of composition. In embodiments, the composition may include $1\times10^8$ to $1\times10^9$ PFU, $1\times10^8$ to $1\times10^{10}$ PFU, or $1\times10^8$ to $1\times10^{11}$ PFU of each phage per mL of composition. In embodiments, the composition may include $1\times10^9$ to $1\times10^{10}$ PFU or $1\times10^9$ to $1\times10^{11}$ PFU of each phage per mL of composition. In embodiments, the composition may include $1\times10^{10}$ to $1\times10^{11}$ PFU of each phage per mL of composition. In embodiments, one or more bacteriophage(s)

may be combined to form a composition include $1\times10^5$, $1\times10^6$, $1\times10^7$, $1\times10^8$, $1\times10^9$ or $1\times10^{10}$, or $1\times10^{11}$ PFU of each phage per mL of composition. In some embodiments, the composition includes equal (or substantially equal) concentrations of each bacteriophage included herein. Suitable concentrations include any value or subrange within the indicated ranges, including endpoints.

In some aspects, the bacteriophage in the composition are purified or substantially purified.

When selecting bacteriophages for inclusion in a composition of the invention, the methods taught in WO 2013/164640 AI (incorporated herein by reference in its entirety) may be used. In one embodiment, the method comprises: a. providing two or more different bacteriophages, wherein each of the bacteriophages independently retards growth of a target bacteria species or strain; b. combining at least two of the bacteriophages; and c. determining growth of the target bacteria species or strain in the presence of the combination of two or more different bacteriophages, wherein the target bacteria species or strain growth conditions are the same or equivalent in steps a. and c.; d. wherein, if the combination retards growth of the target bacterial species or strain at least equal to the greatest growth retardation achieved independently by any one of the bacteriophages, the combination is accepted as a composition of bacteriophages; and e. wherein, if the combination retards growth of the target bacterial species or strain less than the greatest growth retardation achieved independently by any one of the bacteriophages, the combination is initially rejected as a composition of bacteriophages.

In embodiments, the range of target bacteria affected (i.e. lysed, killed) by the composition is broader than the range of target bacteria affected by any single bacteriophage included within the composition. Such activity may be considered additive and/or synergistic. Activity can be considered synergistic if the effect of the composition (target killing range) is greater than the sum of individual effects (target killing range) of each component bacteriophage.

In one embodiment (alternatively or additionally) a "mutant" bacteriophage is capable of lysing some or all the same target bacterial strains as one or more of *E. coli* phage Ec20, Ec34, Ec35, Ec45, Ec56, and Ec57, and/or further capable of lysing one or more additional bacterial strains. In one embodiment, a mutant may have at least 90%, 91%, 92%, 93%, 94%, 95%, 96%, 97%, 98%, or 99% sequence identity to a nucleic acid sequence of one or more of *E. coli* phage Ec20, Ec34, Ec35, Ec45, Ec56, and Ec57. In some embodiments, a mutant or variant may have at least 90%, 91%, 92%, 93%, 94%, 95%, 96%, 97%, 98%, or 99% sequence identity across its entire genome when compared to one more *E. coli* phage. In one embodiment, a mutant may have at least 93%, 94%, 95%, 96%, 97%, 98%, or 99% sequence identity across its entire genome when compared to SEQ ID NO.: 1, SEQ ID NO.: 2, SEQ ID NO.: 3, SEQ ID NO.: 4, SEQ ID NO.: 5, and/or SEQ ID NO.: 6.

In one embodiment (alternatively or additionally) a "mutant" bacteriophage is capable of lysing some or all the same target bacterial strains as one or more of *B. fragilis* phage Bf1, Bf2, Bf3, and Bf4, and/or further capable of lysing one or more additional bacterial strains. In one embodiment, a mutant may have at least 90%, 91%, 92%, 93%, 94%, 95%, 96%, 97%, 98%, or 99% sequence identity to a nucleic acid sequence of one or more of *B. fragilis* phage Bf1, Bf2, Bf3, and Bf4. In some embodiments, a mutant or variant may have at least 90%, 91%, 92%, 93%, 94%, 95%, 96%, 97%, 98%, or 99% sequence identity across its entire genome when compared to one more of *B. fragilis* phage Bf1, Bf2, Bf3, and Bf4.

In embodiments, a "mutant" may be a bacteriophage progeny. A bacteriophage progeny may be a bacteriophage obtainable after lysing target bacteria (e.g. carcinogenic bacteria) using a bacteriophage as described herein (i.e., the "parent bacteriophage"). In other words, the bacteriophage progeny may be a second (or further) generation bacteriophage.

In embodiments, a bacteriophage progeny is obtainable by contacting one or more bacteriophage(s) described herein, including for example, Ec20, Ec34, Ec35, Ec45, Ec56, Ec57, Bf1, Bf2, Bf3, and/or Bf4, with a target bacteria such that the one or more bacteriophage(s) infects and lyses the target bacteria; and obtaining a bacteriophage released following lysis of the target bacteria. The bacteriophage progeny will typically comprise one or more nucleotide(s) mutation(s) when compared to the relevant parent bacteriophage.

The term "obtainable" as used herein also encompasses the term "obtained." In one embodiment, the term "obtainable" means obtained.

The bacteriophage composition can be an alternative to conventional antibacterial agents and/or cancer therapeutics, and overcomes one or more problems associated therewith. In embodiments, the bacteriophage composition can be utilized as co-treatment or in combination with conventional antibacterial agents and/or cancer therapeutics.

In some embodiments, the composition further comprises an antibiotic (e.g., a chemical antibiotic). In some embodiments, the target bacteria are resistant to one or more antibiotics. In some embodiments, the target bacteria are characterized by the presence of a bacterial biofilm.

In some embodiments, the composition further comprises a cancer therapeutic. In some embodiments, the cancer therapeutic comprises an immunotherapeutic agent. In one embodiment, the immunotherapeutic agent is an immune checkpoint inhibitor. In one embodiment, the immunotherapeutic agent comprises anti-PD-1, anti-PD-L1, anti-CTLA-4, anti-CD27, or anti-IDO-1. In some embodiments, the cancer therapeutic comprises a chemotherapeutic agent. In one embodiment, the chemotherapeutic agent is 5-Fluorouracil (5-FU), capecitabine, irinotecan, oxaliplatin, Trifluridine and/or tipiracil.

In some embodiments, the composition further comprises a pharmaceutically acceptable carrier, diluent, excipient or combinations thereof. In one embodiment, the pharmaceutically acceptable carrier, diluent, excipient or combinations thereof comprises magnesium or calcium salts.

In embodiments, the bacteriophage composition includes a preservative agent for storage. In embodiments, the bacteriophage composition includes a cryoprotectant. In embodiments, the preservative agent is glycerol. In embodiments, the preservative agent and/or cryoprotectant is present in the composition in an amount sufficient to preserve the composition, for example during storage in a freezer or ultra-freezer (e.g., at temperatures from about 0° C. to about −80° C., more preferably from about −20° C. to about −80° C., most preferably about −80° C.), or in liquid nitrogen. In a more preferred embodiment, the preservative agent is present in the composition in an amount sufficient to preserve the composition during long-term storage, e.g., in a freezer, ultra-freezer, or liquid nitrogen. In one embodiment, the preservative agent is between about 5% and about 50% glycerol; more preferably between about 10% and about 30% glycerol; most preferably about 20% glycerol. Suitable concentrations may be any value or sub value within the recited ranges, including endpoints.

In embodiments, the composition is an oral freeze-dried, spray freeze-dried, aerosolized formulation of the composition. In some embodiments, the composition is administered intravenously. In some embodiments, the composition is administered orally with and without micro-encapsulated or nano delivery systems. In some embodiments, the composition is administered as a suppository.

Formulations

Provided herein are bacteriophage compositions that include or consist essentially of one more of the bacteriophages described herein. In some aspects the compositions can be substantially free of bacterial components, such as for example, bacterial endotoxin, bacterial host cell components and materials (e.g., protein), and the like. In some embodiments, the compositions includes one or more obligately lytic bacteriophages. The one or more bacteriophages may include a nucleic acid, for example, a genome including a nucleotide sequence having 85%-100% identity to one or more of SEQ ID NOs: 1-6. In some embodiments, at least one or more phages have at least 85%, but not 100%, nucleic acid sequence identity to any one of SEQ ID NOs: 1-6. Each individual bacteriophage may be one that is not prone to generalized transduction and/or does not carry antibiotic resistance genes. The phage can be naturally occurring or non-naturally occurring. In some embodiments for example, in compositions with more than one bacteriophage, at least one can be naturally occurring, at least one can be non-naturally occurring, or none can be naturally occurring. The compositions optionally may include a cryoprotectant or excipient. The excipient may stabilize phage potency or reduce potency loss over time, for example.

In some embodiments, bacteriophage compositions provided herein further include a pharmaceutically acceptable carrier, diluent, excipient or combinations thereof. Suitable carriers, diluents and/or excipients may include isotonic saline solutions, such as phosphate-buffered saline. "Pharmaceutically acceptable excipient" and "pharmaceutically acceptable carrier" refer to a substance that aids the administration of an active agent to and/or absorption by a subject and can be included in the compositions of the present disclosure without causing a significant adverse toxicological effect on the patient. Non-limiting examples of pharmaceutically acceptable excipients include water, NaCl, normal saline solutions, lactated Ringer's, normal sucrose, lactose, leucine, normal glucose, binders, fillers, disintegrants, lubricants, coatings, sweeteners, flavors, salt solutions (such as Ringer's solution), alcohols, oils, gelatins, carbohydrates such as lactose, amylose or starch, fatty acid esters, hydroxymethycellulose, polyvinyl pyrrolidine, and colors, and the like. Such preparations can be sterilized and, if desired, mixed with auxiliary agents such as lubricants, preservatives, stabilizers, wetting agents, emulsifiers, salts e.g. for influencing osmotic pressure, buffers, coloring, and/or aromatic substances and the like that do not deleteriously react with the compounds of the disclosure. One of skill in the art will recognize that other pharmaceutical excipients are useful in the present disclosure.

A bacteriophage composition as described herein may be formulated for nasal, oral, parenteral, intramuscular, intravenous, or subcutaneous administration. Such a bacteriophage preparation may be used directly, refrigerated, lyophilized, stored frozen in aqueous or other solution, optionally with an appropriate cryoprotectant (e.g. 20% glycerol), freeze dried and rehydrated prior to use, or rendered stable in some other formulation including (but not limited to) tablet, emulsion, ointment, or impregnated wound dressing or other item. In embodiments, the cyroprotectant is 10-30% glycerol. In embodiments, the cryoprotectant is 10%, 11%, 12%, 13%, 14%, 15%, 16%, 17%, 18%, 19% 20%, 21%, 22%, 23%, 24%, 25%, 26%, 27%, 28%, 29%, or 30% glycerol.

In embodiments, the bacteriophage composition includes saline (e.g., phosphate buffered saline, with or without magnesium). In embodiments, the bacteriophage composition includes a buffer. In embodiments, the buffer includes calcium or magnesium salts. In an embodiment, the buffer includes phosphate buffered saline and $MgSO_4$. The buffer may include 1 mM to 20 mM $MgSO_4$, 2 mM to 19 mM $MgSO_4$, 3 mM to 17 mM $MgSO_4$, 4 mM to 16 mM $MgSO_4$, 5 mM to 15 mM $MgSO_4$, 6 mM to 14 mM $MgSO_4$, 7 mM to 13 mM $MgSO_4$, 8 mM to 12 mM $MgSO_4$, 9 mM to 11 mM $MgSO_4$, or about 10 mM $MgSO_4$. The concentration may be any value or subrange within the recited ranges, including endpoints. For example, the buffer may include about 1 mM $MgSO_4$, about 2 mM $MgSO_4$, about 3 mM $MgSO_4$, about 4 mM $MgSO_4$, about 5 mM $MgSO_4$, about 6 mM $MgSO_4$, about 7 mM $MgSO_4$, about 8 mM $MgSO_4$, about 9 mM $MgSO_4$, about 10 mM $MgSO_4$, about 11 mM $MgSO_4$, about 12 mM $MgSO_4$, about 13 mM $MgSO_4$, about 14 mM $MgSO_4$, about 15 mM $MgSO_4$, about 16 mM $MgSO_4$, about 17 mM $MgSO_4$, about 18 mM $MgSO_4$, about 19 mM $MgSO_4$, or about 20 mM $MgSO_4$. In embodiments, the buffer includes calcium chloride, $CaCl_2$). The buffer may include 1 mg/L to 20 mg/L $CaCl_2$), 2 mg/L to 19 mg/L $CaCl_2$), 3 mg/L to 17 mg/L $CaCl_2$), 4 mg/L to 16 mg/L $CaCl_2$), 5 mg/L to 15 mg/L $CaCl_2$), 6 mg/L to 14 mg/L $CaCl_2$), 7 mg/L to 13 mg/L $CaCl_2$), 8 mg/L to 12 mg/L $CaCl_2$), 9 mg/L to 11 mg/L $CaCl_2$, or about 10 mg/L $CaCl_2$). For example, the buffer may include about 1 mg/L $CaCl_2$), about 2 mg/L $CaCl_2$), about 3 mg/L $CaCl_2$), about 4 mg/L $CaCl_2$), about 5 mg/L $CaCl_2$), about 6 mg/L $CaCl_2$), about 7 mg/L $CaCl_2$), about 8 mg/L $CaCl_2$), about 9 mg/L $CaCl_2$), about 10 mg/L $CaCl_2$), about 11 mg/L $CaCl_2$), about 12 mg/L $CaCl_2$), about 13 mg/L $CaCl_2$), about 14 mg/L $CaCl_2$), about 15 mg/L $CaCl_2$), about 16 mg/L $CaCl_2$), about 17 mg/L $CaCl_2$), about 18 mg/L $CaCl_2$), about 19 mg/L $CaCl_2$), or about 20 mg/L $CaCl_2$).

A bacteriophage composition may be formulated for nasal, oral, parenteral, intramuscular, intravenous, or subcutaneous administration. Such a bacteriophage preparation may be used directly, stored frozen in aqueous or other solution, optionally with an appropriate cryoprotectant (e.g., 10% sucrose or glycerol), stored in refrigeration temperatures, freeze dried and rehydrated prior to use, or rendered stable in some other formulation including (but not limited to) tablet, emulsion, ointment, or impregnated wound dressing or other item. In some embodiments, the bacteriophage composition may be comprised in an intravenous delivery means.

In some embodiments, the bacteriophage composition is sterile. Such a sterile product may be suitable for parenteral administration in a subject.

In some embodiments, provided herein are oral formulations including the bacteriophage and/or bacteriophage compositions/formulations as described herein. Some embodiments relate to methods and uses of such oral formulations.

Uses/Methods of Use

Provided herein is a use of one or more bacteriophage or a bacteriophage composition as a medicament (e.g., for treating or preventing cancer). Corresponding methods of treating a disease comprising administration of the one or more bacteriophage or bacteriophage composition(s) to a subject are also provided.

In an aspect, there is provided a bacteriophage composition for use in treating a bacterial infection. In related aspects, there is provided use of a bacteriophage composition in the manufacture of a medicament for treating a bacterial infection, as well as a method of treating a bacterial infection comprising administering the bacteriophage composition to a subject.

In an aspect, provided herein are methods of treating a bacterial-associated cancer including selecting a subject with a confirmed infection of a bacteria associated with cancer and administering a bacteriophage composition as described herein. In one embodiment, the method comprises selecting a subject with an infection of a bacteria associated with cancer. In embodiments, the method includes selecting a patient having colorectal cancer. In embodiments, the method includes selecting a patient having a pks+*E. coli* infection. In embodiments, the method includes selecting a patient having a pks+*E. coli* infection. In embodiments, the method includes selecting a patient having a pks+*E. coli* strain infection. In embodiments, the method includes selecting a patient having colorectal cancer due to infection by *E. coli* bacteria. In embodiments, the method includes selecting a patient having a *Bacteroides fragilis* infection. In embodiments, the method includes selecting a patient having a *B. fragilis* Clindamycin resistant infection. In embodiments, the method includes selecting a patient having a *B. fragilis* Clindamycin sensitive infection. In embodiments, the method includes selecting a patient having colorectal cancer due to infection by *B. fragilis* bacteria.

In embodiments, the subject has a genetic predisposition for one or more additional cancers. In some embodiments, the subject has been screened for a genetic mutation that predisposes the patient to cancer. In some embodiments, the genetic mutation is familial adenomatous polyposis.

The cancer may be any cancer that is known or suspected of being due to infection by a bacterial species or strain. Cancers or tumors that can be treated by the compositions and methods described herein include, but are not limited to: biliary tract cancer; brain cancer, including glioblastomas and medulloblastomas; breast cancer; cervical cancer; choriocarcinoma; colon cancer; endometrial cancer; esophageal cancer, gastric cancer; hematological neoplasms, including acute lymphocytic and myelogenous leukemia; multiple myeloma; AIDS associated leukemias and adult T-cell leukemia lymphoma; intraepithelial neoplasms, including Bowen's disease and Paget's disease; liver cancer (hepatocarcinoma); lung cancer; lymphomas, including Hodgkin's disease and lymphocytic lymphomas; neuroblastomas; oral cancer, including squamous cell carcinoma; ovarian cancer, including those arising from epithelial cells, stromal cells, germ cells and mesenchymal cells; pancreas cancer; prostate cancer; rectal cancer; sarcomas, including leiomyo sarcoma, rhabdomyosarcoma, liposarcoma, fibrosarcoma and osteosarcoma; skin cancer, including melanoma, Kaposi's sarcoma, basocellular cancer and squamous cell cancer; testicular cancer, including germinal tumors (seminoma, non-seminoma [teratomas, choriocarcinomas]), stromal tumors and germ cell tumors; thyroid cancer, including thyroid adenocarcinoma and medullar carcinoma; and renal cancer including adenocarcinoma and Wilms tumor. In important embodiments, cancers or tumors include breast cancer, lymphoma, multiple myeloma, and melanoma. In embodiments, the cancer is colorectal cancer, esophageal cancer, gallbladder cancer, lung cancer, squamous cell carcinoma, bladder cancer, stomach cancer, or MALT lymphoma. In embodiments, the cancer is colorectal cancer. In embodiments, the cancer is esophageal cancer. In embodiments, the cancer is gallbladder cancer. In embodiments, the cancer is lung cancer. In embodiments, the cancer is squamous cell carcinoma. In embodiments, the cancer is bladder cancer. In embodiments, the cancer is stomach cancer. In embodiments, the cancer is MALT lymphoma.

In some embodiments, the infection is characterized by the presence of a bacterial biofilm. In some embodiments, the bacterial infection is chronic. In some embodiments, the bacterial infection is acute.

In some embodiments, the subject has a bacterial infection that is not responding to one or more antibiotics. In some embodiments, the subject has a bacterial infection that is not responding to standard-of-care antibiotics.

In embodiments, one or more bacterial isolates from the subject is tested for susceptibility to the bacterial composition prior to administration.

As used herein, a "therapeutically effective amount" is any amount of the composition, which when administered alone or in combination to a subject for treating a bacterial infection (or a symptom thereof) is sufficient to effect such treatment of the infection, or symptom thereof.

As used herein, a "prophylactically effective amount" is any amount of the composition that, when administered alone or in combination to a subject inhibits or delays the onset or reoccurrence of a bacterial infection (or a symptom thereof). In some embodiments, the prophylactically effective amount prevents the onset or reoccurrence of a bacterial infection entirely. "Inhibiting" the onset means either lessening the likelihood of a bacterial infection's onset (or symptom thereof), or preventing the onset entirely.

An appropriate dosage range is one that produces the desired therapeutic effect (e.g., the composition is dosed in a therapeutically or prophylactically effective amount).

In one embodiment, the subject is a human subject with a bacterial associated cancer (e.g. colorectal cancer). In embodiments, the composition includes $1 \times 10^5$ to $1 \times 10^{11}$ PFU of each phage per mL of composition. In embodiments, the composition includes $1 \times 10^5$ to $1 \times 10^6$ PFU, $1 \times 10^5$ to $1 \times 10^7$ PFU, $1 \times 10^5$ to $1 \times 10^8$ PFU, $1 \times 10^5$ to $1 \times 10^9$ PFU, or $1 \times 10^5$ to $1 \times 10^{10}$ PFU of each phage per mL of composition. In embodiments, the composition includes $1 \times 10^5$ to $1 \times 10^7$ PFU, $1 \times 10^6$ to $1 \times 10^8$ PFU, $1 \times 10^6$ to $1 \times 10^9$ PFU, $1 \times 10^6$ to $1 \times 10^{10}$ PFU, or $1 \times 10^6$ to $1 \times 10^{11}$ PFU of each phage per mL of composition. In embodiments, the composition includes $1 \times 10^7$ to $1 \times 10^8$ PFU, $1 \times 10^7$ to $1 \times 10^9$ PFU, $1 \times 10^7$ to $1 \times 10^{10}$ PFU, or $1 \times 10^7$ to $1 \times 10^{11}$ PFU of each phage per mL of composition. In embodiments, the composition includes $1 \times 10^8$ to $1 \times 10^9$ PFU, $1 \times 10^8$ to $1 \times 10^{10}$ PFU, or $1 \times 10^8$ to $1 \times 10^{11}$ PFU of each phage per mL of composition. In embodiments, the composition includes $1 \times 10^9$ to $1 \times 10^{10}$ PFU or $1 \times 10^9$ to $1 \times 10^{11}$ PFU of each phage per mL of composition. In embodiments, the composition may include $1 \times 10^{10}$ to $1 \times 10^{11}$ PFU of each phage per mL of composition.

In embodiments, a bacteriophage composition is administered to a subject at a dosage of at least about $1 \times 10^5$ PFU of each phage, at least about $1 \times 10^6$ PFU of each phage, at least about $1 \times 10^7$ PFU of each phage, at least about $1 \times 10^8$ PFU of each phage, at least about $1 \times 10^9$ PFU of each phage, at least about $1 \times 10^{10}$ PFU of each phage, or at least about $1 \times 10^{11}$ PFU of each phage per mL of composition. In embodiments, one or more bacteriophage(s) may be combined to form a composition including $1 \times 10^5$, $1 \times 10^6$, $1 \times 10^7$, $1 \times 10^8$, $1 \times 10^9$, or $1 \times 10^{10}$ or $1 \times 10^{11}$ PFU of each phage per mL of composition. Dosages include any value or range within the recited ranges, including endpoints.

In some embodiments, bacteriophage compositions provided herein are administered to a subject at a dosage of at least about $1\times10^5$ PFU total phage, at least about $1\times10^6$ PFU total phage, at least about $1\times10^7$ PFU total phage, at least about $1\times10^8$ PFU total phage, at least about $1\times10^9$ PFU total phage, at least about $1\times10^{10}$ PFU total phage, or at least about $1\times10^{11}$ PFU of total phage. The bacteriophage composition is administered at a dosage of between about $1\times10^5$ to about $1\times10^{11}$ PFU of total phage per mL of composition. In embodiments, the bacteriophage composition is administered at a dosage of between about $1\times10^5$ to about $1\times10^6$ PFU, between about $1\times10^5$ to about $1\times10^7$ PFU, between about $1\times10^5$ to about $1\times10^8$ PFU, between about $1\times10^5$ to about $1\times10^9$ PFU, or between about $1\times10^5$ to about $1\times10^{10}$ PFU of total phage per mL of composition. In embodiments, the bacteriophage composition is administered at a dosage of between about $1\times10^6$ to about $1\times10^7$ PFU, between about $1\times10^6$ to about $1\times10^8$ PFU, between about $1\times10^6$ to about $1\times10^9$ PFU, between about $1\times10^6$ to about $1\times10^{10}$ PFU, or between about $1\times10^6$ to about $1\times10^{11}$ PFU of total phage per mL of composition. In embodiments, the bacteriophage composition is administered at a dosage of between about $1\times10^7$ to about $1\times10^8$ PFU, between about $1\times10^7$ to about $1\times10^9$ PFU, between about $1\times10^7$ to about $1\times10^{10}$ PFU, or between about $1\times10^7$ to about $1\times10^{11}$ PFU of each phage per mL of composition. In embodiments, the bacteriophage composition is administered at a dosage of between about $1\times10^8$ to about $1\times10^9$ PFU, between about $1\times10^8$ to about $1\times10^{10}$ PFU, or between about $1\times10^8$ to about $1\times10^{11}$ PFU of total phage per mL of composition. In embodiments, the bacteriophage composition is administered at a dosage of between about between about $1\times10^9$ to about $1\times10^{10}$ PFU, or between about $1\times10^9$ to about $1\times10^{11}$ PFU of total phage per mL of composition. In embodiments, the bacteriophage composition is administered at a dosage of between about $1\times10^{10}$ to about $1\times10^{11}$ PFU of total phage per mL of composition. A dosage may be $3\times10^9$ PFU per milliliter composition. Dosages include any value or range within the recited ranges, including endpoints.

In some embodiments, the bacteriophage composition is administered at least once, twice, three times, or four times daily. Suitably the bacteriophage composition may be administered twice daily. In one embodiment, therefore, a dosage of at least about $1\times10^5$ PFU of each phage is administered at least once, twice, three times, or four times daily. In one embodiment, therefore, a dosage of at least about $1\times10^6$ PFU of each phage is administered at least once, twice, three times, or four times daily. In another embodiment at least about $1\times10^7$ PFU of each phage is administered at least once, twice, three times, or four times daily. In a further embodiment at least about $1\times10^8$ PFU of each phage is administered at least once, twice, three times, or four times daily. In another embodiment at least about $1\times10^9$ PFU of each phage is administered at least once, twice, three times, or four times daily. In another embodiment at least about $1\times10^{10}$ PFU of each phage is administered at least once, twice, three times, or four times daily. In another embodiment at least about $1\times10^{11}$ PFU of each phage is administered at least once, twice, three times, or four times daily. A dosage range between about $1\times10^5$ PFU of each phage to about $1\times10^{11}$ PFU of each phage may be administered at least once, twice, three times, or four times daily. Preferably a dosage range between about $1\times10^7$ PFU of each phage to about $1\times10^9$ PFU of each phage may be administered at least once, twice, three times, or four times daily.

In some embodiments, the bacteriophage composition is administered every 2 hours, every 4 hours, every 6 hours, every 8 hours, every 12 hours, every 24 hours, every 48 hours, or every 72 hours. In some embodiments, the bacteriophage composition is administered every 2 hours. In some embodiments, the bacteriophage composition is administered every 4 hours. In some embodiments, the bacteriophage composition is administered every 6 hours. In some embodiments, the bacteriophage composition is administered every 8 hours. In some embodiments, the bacteriophage composition is administered every 12 hours. In some embodiments, the bacteriophage composition is administered every 24 hours. In some embodiments, the bacteriophage composition is administered every 48 hours. In some embodiments, the bacteriophage composition is administered every 72 hours. Frequency of administration include any value or range within the recited ranges, including endpoints.

In some embodiments, the bacteriophage composition is administered for at least one day, at least 2 days, at least 3 days, at least 4 days, at least 5 days, at least 6 days, one week, at least two weeks, at least three weeks, at least four weeks, at least 5 weeks, at least 6 weeks, at least 7 weeks, at least 8 weeks, at least 9 weeks, at least 10 weeks, or more than 10 weeks. In some embodiments, the bacteriophage composition is administered for at least one day. In some embodiments, the bacteriophage composition is administered for at least one week. In some embodiments, the bacteriophage composition is administered for at least two weeks. In some embodiments, the bacteriophage composition is administered for at least three weeks. In some embodiments, the bacteriophage composition is administered for at least four weeks. In some embodiments, the bacteriophage composition is administered for at least five weeks. In some embodiments, the bacteriophage composition is administered for at least six weeks. In some embodiments, the bacteriophage composition is administered for between about 3 days and about 100 days. In an embodiment, the bacteriophage composition is administered for between about 7 days and about 60 days. In an embodiment, the bacteriophage composition is administered for between about 14 days and about 30 days. In an embodiment, the bacteriophage composition is administered for between about 3 days and about 28 days. In an embodiment, the bacteriophage composition is administered for at least 14 days. In an embodiment, the bacteriophage composition is administered for greater than 14 days. Duration of administration includes any value or range within the recited ranges, including endpoints. In embodiments, treatment may be delivered prophylactically (i.e. if the bacteria is detected, there is a genetic predisposition to cancer, but no cancer detected yet) to decontaminate the gut. In those instances, decolonization periods could be as long as those of treatment as described above.

A bacteriophage composition for use as a medicament may be administered by any route selected based on the condition to be treated. In one embodiment the route of administration is nasal, oral, pulmonary, parenteral, intramuscular, intravenous, subcutaneous, transdermal, ocular, aural or combinations thereof. In embodiments, the route of administration is oral. The composition may be administered to the patient via more than one route, for example oral and intravenous.

In one embodiment an antibiotic (suitably a chemical antibiotic) may be administered in combination with the bacteriophage composition of the invention. Combinatorial administration of antibiotics and bacteriophages is taught in WO 2008/110840 and WO 2005/009451, which teaching is incorporated herein by reference in its entirety. The antibiotic may be administered simultaneously or sequentially with the bacteriophage composition. Suitably, the one or more antibiotics may be administered after the composition such that bacteriophage replication has become established before antibiotic treatment begins. In this case, antibiotic treatment may be delayed for one or more hours or days from application of the one or more bacteriophages, e.g., from 1 to 2, 3, 4, 5, 6, 7, 8, 9 or 10 days. Where a bacteriophage composition comprising a plurality of bacteriophages is employed with each member of the composition exhibiting different strain specificity, it will suffice that at least a proportion (e.g., one or more bacteriophage(s)) of the composition is capable of targeting the bacterial infection.

Thus, in some embodiments a bacteriophage composition comprises one or more antibiotics, such as one or more chemical antibiotics. An antibiotic may be selected based on sensitivity of the target species or strain to said antibiotic. Suitably the species or strain may be the same species or strain present in a subject to be treated. In one embodiment, a species or strain is taken from a subject to be treated and tested for antibiotic sensitivity. Sensitivity may be determined by in vitro sensitivity assays known in the art.

Alternatively or additionally, an antibiotic may be selected because it is known to be active against a bacteria known to be (or thought likely to be) present together with a bacterial infection to be treated (e.g., as part of a bacterial biofilm).

In one embodiment and without limitation, an antibiotic is one or more selected from: a penicillin, a lincosamide, a monobactam, a cephalexin, a macrolide, a fluoroquinolone, a sulfonamide, a tetracycline, a cephalosporin, a cephamycin, a carbapenem a glycylcycline, a phenicol, a folate pathway inhibitor, a polymyxin, a phosphonic acid, a nitroimidazole, or an aminoglycoside.

In one embodiment, a use or method of the invention comprises: a. administration of a bacteriophage composition to a subject in vivo; b. in vitro monitoring of the sensitivity of a sample of bacterial cells from an infection (e.g., present in the subject) or from another infection by the same strain to one or more antibiotic(s); and c. administration of said one or more antibiotic(s), when it has been established that said sensitivity to said one or more antibiotic(s) has been induced.

In one embodiment, the antibiotic (e.g., chemical antibiotic) is administered at a time period at which sensitivity of sampled bacteria to the antibiotic is induced by the composition. In some embodiments, the time period may be at least 12, 24 or 48 hours. In other embodiments, the bacteriophage composition and the antibiotic may be administered at intervals of one day to two months apart, preferably at intervals of one to four weeks apart, suitably at intervals of two weeks apart.

In embodiments, provided herein are methods for restoring sensitivity to an antibiotic(s) by administering a composition as described herein. In embodiments, provided herein methods for disrupting a biofilm by administering a composition as described herein. In embodiments, provided herein are methods for destroying a biofilm by administering a composition as described herein.

In some embodiments, the bacteriophage composition as described herein may be administered with at least one additional cancer treatment. In one embodiment, the at least one additional cancer treatment comprises an immunotherapeutic agent. Immunotherapeutic agents include, for example and without limitation, checkpoint inhibitors, anti-tumor antibodies (therapeutic antibodies), cancer vaccines, and other cancer treatments that boost the immune system. In one embodiment, the immunotherapy agent comprises anti-PD-1, anti-PD-L1, anti-CTLA-4, anti-CD27, or anti-IDO-1. Examples of PD-1 inhibitors include, without limitation, pembrolizumab, nivolumab, pidilizumab, AMP-224, AMP-514, and PDR001. Examples of PD-L1 inhibitors include, without limitation, atezolizumab, avelumab, durvalumab, and BMS-936559.

In some embodiments, the one or more additional agents comprise a chemotherapeutic agent. In one embodiment, the chemotherapeutic agent is 5-Fluorouracil (5-FU), capecitabine, irinotecan, oxaliplatin, Trifluridine and/or tipiracil. Additional anti-cancer agents, including additional immunotherapy and chemotherapy agents, are well known in the art.

The type and dose of the anti-cancer agent can be determined by a skilled clinician. For example and without limitation, anti-cancer agents approved for stomach (gastric) cancers include Cyramza (Ramucirumab), Docetaxel, Doxorubicin Hydrochloride, 5-FU (Fluorouracil Injection), Fluorouracil Injection, Herceptin (Trastuzumab), Mitomycin C, Mitozytrex (Mitomycin C), Mutamycin (Mitomycin C), Ramucirumab, Taxotere (Docetaxel), Trastuzumab, FU-LV, TPF, XELIRI. Anti-cancer agents approved for colon and/or rectal cancer include, for example and without limitation, Avastin (Bevacizumab), Camptosar (Irinotecan Hydrochloride), Capecitabine, Cetuximab, Cyramza (Ramucirumab), Eloxatin (Oxaliplatin), Erbitux (Cetuximab), 5-FU (Fluorouracil Injection), Fluorouracil Injection, Irinotecan Hydrochloride, Leucovorin Calcium, Lonsurf (Trifluridine and Tipiracil Hydrochloride), Nivolumab, Opdivo (Nivolumab), Oxaliplatin, Panitumumab, Ramucirumab, Regorafenib, Stivarga (Regorafenib), Trifluridine and Tipiracil Hydrochloride, Vectibix (Panitumumab), Wellcovorin (Leucovorin Calcium), Xeloda (Capecitabine), Zaltrap (Ziv-Aflibercept), Ziv-Aflibercept, CAPDX, FOLFIRI, FOLFIRI-BEVACIZUMAB, FOLFIRI-CETUXIMAB, FOLFOX, FU-LV, XELIRI, and XELOX.

The present invention also provides a kit comprising: a bacteriophage composition according to the invention; and instructions for use of same (e.g., in medicine). The kit may further comprise an additional agent, such as an antibiotic (e.g., a chemical antibiotic), an immunotherapeutic agent, or a chemotherapeutic agent, and optionally instructions for use of same in combination with the bacteriophage composition.

In one embodiment, the instructions provide details for dosing a bacteriophage composition of the invention as described herein.

Unless defined otherwise, all technical and scientific terms used herein have the same meaning as commonly understood by one of ordinary skill in the art to which this disclosure belongs. Singleton, et al., DICTIONARY OF MICROBIOLOGY AND MOLECULAR BIOLOGY, 20 ED., John Wiley and Sons, New York (1994), and Hale & Marham, THE HARPER COLLINS DICTIONARY OF BIOLOGY, Harper Perennial, NY (1991) provide one of skill with a general dictionary of many of the terms used in this disclosure.

This disclosure is not limited by the example methods and materials disclosed herein, and any methods and materials similar or equivalent to those described herein can be used in the practice or testing of embodiments of this disclosure. Numeric ranges are inclusive of the numbers defining the range. The headings provided herein are not limitations of the various aspects or embodiments of this disclosure which can be had by reference to the specification as a whole.

Before the example embodiments are described in more detail, it is to be understood that this disclosure is not limited to particular embodiments described, as such may, of course, vary. It is also to be understood that the terminology used herein is for the purpose of describing particular embodiments only, and is not intended to be limiting, since the scope of the present disclosure will be limited only by the appended claims.

Where a range of values is provided, it is understood that each intervening value, to the tenth of the unit of the lower limit unless the context clearly dictates otherwise, between the upper and lower limits of that range is also specifically disclosed. Each smaller range between any stated value or intervening value in a stated range and any other stated or intervening value in that stated range is encompassed within this disclosure. The upper and lower limits of these smaller ranges may independently be included or excluded in the range, and each range where either, neither or both limits are included in the smaller ranges is also encompassed within this disclosure, subject to any specifically excluded limit in the stated range. Where the stated range includes one or both of the limits, ranges excluding either or both of those included limits are also included in this disclosure.

The publications discussed herein are provided solely for their disclosure prior to the filing date of the present application. Nothing herein is to be construed as an admission that such publications constitute prior art to the claims appended hereto. All publications referenced herein are incorporated herein by reference in their entireties.

The invention will now be described, by way of example only, with reference to the following Figures and Examples.

EXAMPLES

Example 1 Assembly of Bacteriophage Cocktail

A cocktail of two to four bacteriophages, which together have broad activity against a panel of recent diverse *E. coli* clinical isolates, is used in animal studies. In an example method, phage lysates are prepared using one or more manufacturing hosts (e.g., *E. coli* strains numbers SPS69, SPS759, SPS765, SPS932), preferably which do not release endogenous prophage(s) during the production cycle. Cultures are grown in bioreactors to an $OD_{600}$ 0.2 prior to phage addition. Incubation at 37° C. is continued and absorbance read at least every 60 minutes. Cultures are harvested after bacterial lysis, and impurities separated from the phages with several filtration steps followed by chromatographic steps that enable reduction of debris such as host cell proteins and host cell DNA, such that final phage titers are $\geq 1 \times 10^{11}$ PFU/mL. At the end of the process, buffer is exchanged and all material is filter-sterilized (0.22 pm filter) and stored at 2-8° C. Plaque assays can be used to titer the phage stocks (Carlson, K., In E. Kutter and A. Sulakvelidze (ed.), Bacteriophages: Biology and Application, (2005) 437-494, CRC Press, Boca Raton, FL, Hyman, P., et al., *Meth. Mol. Biol.* (2009) 501:175-202). The purified phage samples are diluted 1:10, 1:100 or 1:1000 to obtain the dosing solutions and subsequently combined such that each phage is present in the final cocktail at the desired concentration (e.g., about $2 \times 10^{10}$ $2 \times 10^9$ or $2 \times 10^8$ PFU/mL) per phage. Final endotoxin levels are determined.

Example 2 Phage Isolation and Characterization

The following experiments were conducted in an effort to assess in preclinical models the potential of bacteriophages as targeted therapeutics for *E. coli* and *B. fragilis* driven cancers.

Relevant bacteria strains were provided by Johns Hopkins University. Three strains of bacteria were received: 1. *Bacteroides fragilis* 086 (Clindamycin resistant)—AmpliPhi ID #2849; 2. *Bacteroides fragilis* NCTC 9343 (Clindamycin sensitive)—AmpliPhi ID #2850; 3. *E. coli* PL1 (pks+*E. coli*)—AmpliPhi ID #2851.

*Bacteroides* Phage Isolation and Characterization

The *Bacteroides fragilis* strains were grown anaerobically on BHI/Yeast Extract/L-Cysteine agar plates supplemented with Hemin and Vitamin K1 as requested by JHU and stocks prepared on both beads and in 30% glycerol/BHI broth. Stocks were stored frozen at −80° C.

Phage isolation was undertaken for the *Bacteroides fragilis* isolates. Using sewage water samples from the Sydney (Australia) area, phages were successfully isolated against *B. fragilis* ID #2849. Plaque purification of four selected phages (preliminary chosen based on their differing plaque morphology and origin of sewage water samples) was performed and master stocks prepared in phage buffer. Master research stocks of the *Bacteroides fragilis* phages Bf1, Bf2, Bf3 and Bf4, targeting *Bacteroides fragilis* 086 (ID #2849), were propagated by the plate method and further characterized as described in Table 1.

Plate Method: BHI/Yeast Extract/L-Cysteine agar plates supplemented with Hemin and Vitamin K1 were used to propagate the phages. A bacteriophage dilution that was likely to give plates with "confluent lysis" was prepared and mixed with an aliquot of an overnight BHI/Yeast Extract/L-Cysteine supplemented with Hemin and Vitamin K1 broth culture of *Bacteroides fragilis* 086 (ID #2849). 3 mL of BHI/Yeast Extract/L-Cysteine semi-solid supplemented with Hemin and Vitamin K1 agar tempered to 47.5° C. (+/−2.5) in a waterbath was applied to the surface of BHI/Yeast Extract/L-Cysteine agar plates. The plates were incubated under anaerobic conditions at 37° C. overnight. Salt-Magnesium (SM) buffer was added to the plates at 4° C. overnight to elute the bacteriophages. The eluted phages were then filtered through 0.22 μm PES filter and stored at 4° C.

TABLE 1

Characteristics of *Bacteroides fragilis* phages

| AmpliPhi Phage ID# | AmpliPhi Host Strain ID# | Plaque Diameter & Description | Estimated Genome Molecular Weight (kb) | Master stock Titre (PFU/mL) |
|---|---|---|---|---|
| Bf1 | 2849 | 1.5 mm, clear | 43 | $1.1 \times 10^{10}$ |
| Bf2 | 2849 | 2 mm, clear, tiny halo | 45 | $1.3 \times 10^{11}$ |
| Bf3 | 2849 | <1 mm, clear | 46 | $6.0 \times 10^{10}$ |
| Bf4 | 2849 | 1 mm, clear | 46.5 | $3.0 \times 10^{10}$ |

The activity of phages Bf1, Bf2, Bf3 and Bf4 against Clindamysin sensitive *Bacteroides fragilis* (ID #2850) was performed by the spot test method.

Method: Phage activity was assessed by the spot test method, (a modification of the small drop agar overlay method (Mazzocco, 2009)). Briefly, planktonic bacterial culture was mixed with molten dilute agar and poured evenly over an agar plate. When the top agar layer was set, serial dilutions of standardized phage solutions were spotted onto the overlay and plates incubated overnight at 37° C. Phage activity was indicated by clearing of the bacterial lawn at the site of phage application, and by the development of individual plaques as the phage sample is diluted. Strains were only considered sensitive if discrete plaques could be observed as the sample was diluted, indicating phage replication in addition to cell death.

Results are presented in Table 2. Two of the phages, Bf1 and Bf3, that had been isolated against *B. fragilis* ID #2849 were also active against *B. fragilis* ID #2850

TABLE 2

Host Range activity of *B fragilis* phages

|  | Bf1 | Bf2 | Bf3 | Bf4 |
|---|---|---|---|---|
| Bacterial Strain ID # 2849 Clindamycin Resistant | 1.10E+10 | 1.30E+11 | 6.00E+10 | 3.00E+10 |
| Bacterial Strain ID # 2850 Clindamycin Sensitive | 1.00E+05 | 0 | 1.35E+08 | 0 |

Confirmation of In Vitro Activity in Broth Culture

The activity of the four *B. fragilis* phages was also evaluated in vitro in liquid culture in an attempt to understand the phage infection process over time.

Method: 96 well culture plates were prepared with each test well containing 200 μl of a 1/100 overnight culture of *B. fragilis* ID #2849 or *B. fragilis* ID #2850 in BHI/Yeast Extract/L-Cysteine supplemented with Hemin and Vitamin K1 broth. 20 μl of phages Bf1-Bf4 and 20 μl of the phage mix (all 4 phages) were added to the appropriate wells and control wells containing only bacteria were included. The plates were incubated anaerobically for 21 hrs. OD readings at 500-700 nm (Cell growth program) were taken in the Spectrostar plate reader at Time=0 and again at T=6 hours and T=21 hours.

The results obtained in broth culture for *B. fragilis* ID #2849 reflect those seen in the spot test with each phage and the mix inhibiting the growth of the bacteria. (FIG. 1).

Figure 2:
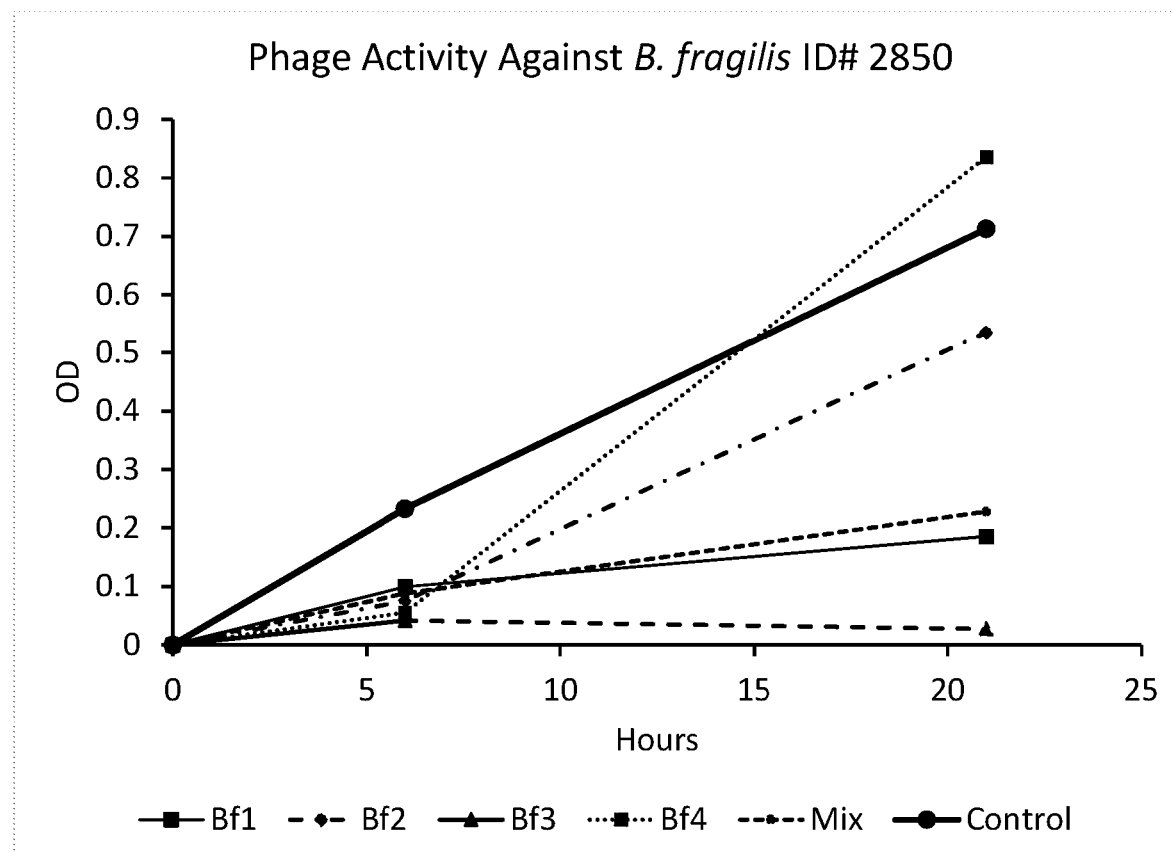
FIG. 2 is a graph of phage activity of four different phage and a mixture of phage against a *Bacteroides fragilis* strain (Clindamycin sensitive).
Figure 3:
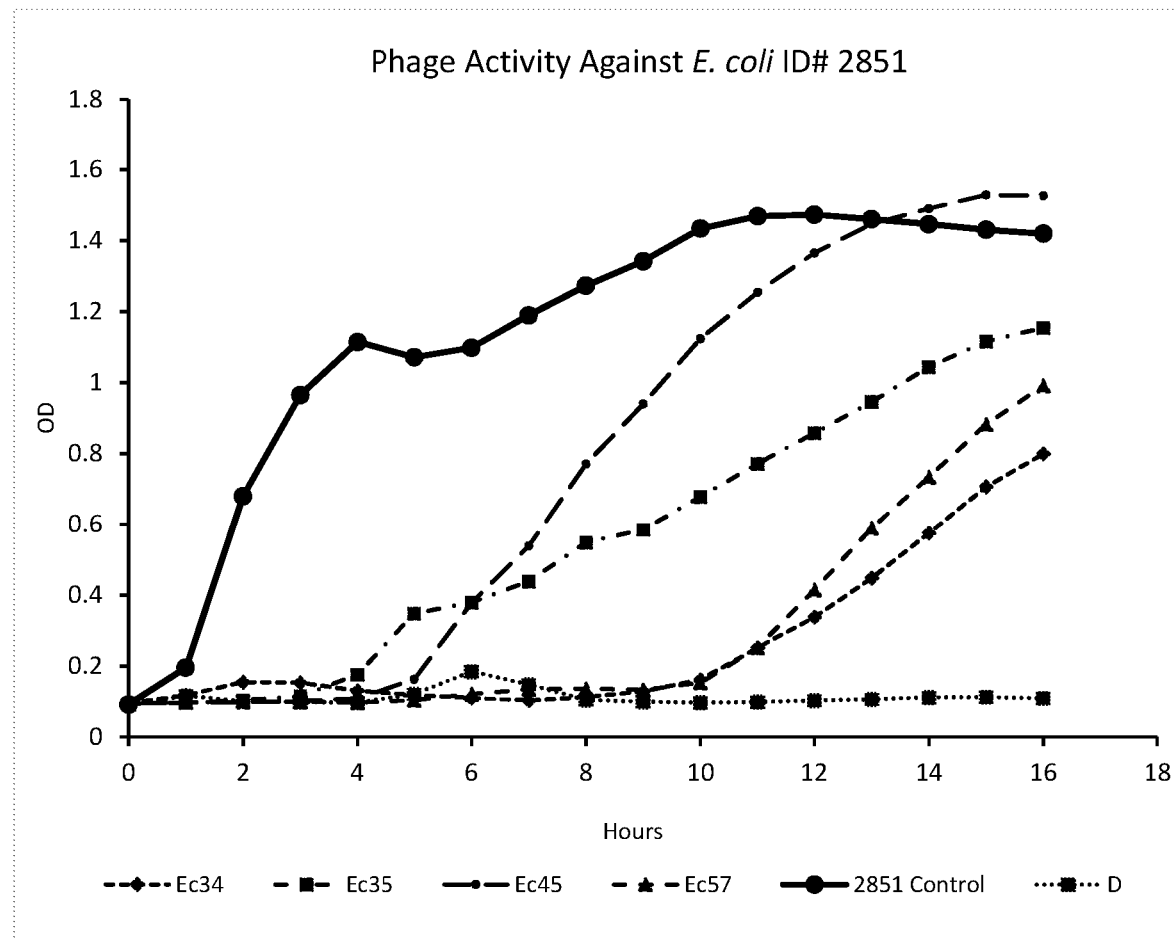
FIG. 3 is a graph of phage activity of four different phage and a mixture of phage against an *Escherichia coli* strain (pks+).

In the spot test, only Bf1 and Bf3 demonstrated active growth against *B. fragilis* ID #2850. The results in broth culture showed that Bf1, Bf3 and the phage mix prevent the growth of the bacteria reflecting the results seen on solid media in the spot test (FIG. 2).

pH Stability Testing of *B. fragilis* Phages

The stability at low pH of the four phages was tested in order to determine their suitability for gavage administration in the mouse model and potential oral delivery in the clinic.

Method: Each of the four phages were diluted in SM buffer pH 7.5 to give an approximately starting concentration of $10^9$ PFU/mL. The phages were then diluted 1/10 from this starting material in SM buffer pH 7.5 (neutral) and SM buffer pH 3.0 (low). Following incubation at 37° C. for 1 hour the samples were serially diluted in SB buffer (pH 7.5) to evaluate the titer by the spot test as described above. Results are shown in Table 3.

TABLE 3 pH stability results

|  | Titre (PFU/mL) pH 7.5 | Titre (PFU/mL) pH 3.0 |
|---|---|---|
| Bf1 | $1.1 \times 10^7$ | $8.0 \times 10^6$ |
| Bf2 | $1.2 \times 10^8$ | $8.0 \times 10^7$ |
| Bf3 | $6.0 \times 10^7$ | $4.4 \times 10^7$ |
| Bf4 | $1.8 \times 10^7$ | $9.0 \times 10^6$ |

The *Bacteroides* phages Bf1, Bf2, Bf3 and Bf4 are resistant to low pH 3.0 at 37° C. for 1 hour making them good candidates for oral delivery.

Example 3. *E. coli* Phage Isolation and Characterization

A pks+*E. coli* strain was grown on nutrient agar and stocks prepared on both beads and in 30% glycerol/nutrient broth. Stocks were stored frozen at −80° C.

The target *E. coli* strain (pks+*E. coli*) AmpliPhi ID #2851 was spot tested (as described above) with four *E. coli* phages (Ec34, Ec35, Ec45, and Ec57) that had been short listed and identified as potential therapeutic components in an *E. coli* investigational product.

All of these phages are predicted to be obligately lytic with little potential for transduction, and no drug-resistance or bacterial virulence genes were identified in their genomes.

TABLE 4

Features of selected *E. coli* phages

| Phage | Size (Kb) | Predicted Morphology | No. Protein-Coding Genes |
|---|---|---|---|
| Ec34 | 167.9 | myovirus | 271 |
| Ec35 | 167.2 | myovirus | 271 |
| Ec45 | 167.5 | myovirus | 267 |
| Ec57 | 167.0 | myovirus | 270 |

TABLE 5

Host Range activity of selected *E. coli* phages

|  | Ec34 | Ec35 | Ec45 | Ec57 |
|---|---|---|---|---|
| *E coli* ID # 2851 | 2.00E+07 | 2.00E+08 | 2.00E+06 | 4.00E+07 |

Confirmation of In Vitro Activity in Broth Culture

Method: 96 well culture plates were prepared with each test well containing 200 μl of a 1/100 overnight culture of *E. coli* PL1 (pks+*E. coli*) AmpliPhi ID #2851 in nutrient broth. Twenty (20) μL of phages Ec34, Ec35, Ec45 and Ec57 and Phage mix D (combination of Ec34, Ec45, and Ec57) were added to the appropriate wells. Control wells containing only bacteria were included. The plates were placed in the Spectrostar plate reader and incubated at 37° C. with shaking. OD readings at 600 nm were taken every 15 minutes for 16 hours.

Growth of the *E. coli* (pks+*E. coli*)—AmpliPhi ID #2851 was partially reduced by the individual phages Ec34, Ec35, and Ec57. Ec45 showed no effect on the growth of the bacteria.

Growth was totally prevented by mix D (Ec34, Ec35, and Ec57). This indicates that the collective bactericidal effect of the 3-phage combination was greater than the simple additive effects of the individual phages.

Example 4. Demonstration of Efficacy in a Mouse Model

Testing of *E. coli*-targeting phages and/or *B. fragilis*-targeting phages in preclinical model (AOM mouse model of colorectal cancer) may be undertaken to demonstrate evidence of efficacy (impact on survival).

Specific pathogen free (SPF) C57BL/6J mice are treated with AOM (Azoxymethane) (10 mg/kg weekly for 6 weeks). AOM induces colorectal cancer in mice and rats. AOM is given weekly until the time of mouse harvest. Prior to inoculation of bacterial strains 6-week-old mice are given water containing 500 mg/L cefoxitin for 48 hours. Cefoxitin treatment results in an absence of detectable bacteria by culture or 16S rRNA qPCR by 24 hours (C. E. DeStefano Shields, S. W. Van Meerbeke, F. Housseau, H. Wang, D. L. Huso, R. A. Casero Jr., H. M. O'Hagan, C. L. Sears, Reduction of murine colon tumorigenesis driven by enterotoxigenic *Bacteroides fragilis* using cefoxitin treatment. J. Infect. Dis. 214, 122-129 (2016)). After removal of antibiotic water for 24 hours, mice are inoculated by oral gavage with $10^8$ colony-forming units (cfu) ETBF or $10^8$ cfu pks+*E. coli* or a mixture containing $10^8$ cfu of each strain. Colonization is confirmed and quantified by collection and cultivation of stool on selective media.

Bacteriophage treatment with the compositions provided herein may be provided in a subset of experimental mice. Analysis of survival of bacteriophage treated and untreated mice may be undertaken.

Example 5. Evaluate Impact of Bacteriophage Treatment on the GI Microbiome

To test whether eliminating pathogenic strains of *E. coli* and/or *B. fragilis* leads to repopulation of the microbiome by benign strains of the same species, microbiome analysis will be undertaken.

Protocols for microbiome analysis have been described (e.g. *Front Cell Infect Microbiol.* 2018; 8: 301). One such protocol includes fecal collection, DNA extraction, and 16S rRNA gene V4 region sequencing. In these experiments, fecal collection is undertaken and the sample is immediately frozen at −20° C. without preservative. Alternatively, reagents such as OMNIgene GUT, 95% ethanol, RNAlater, and Flinders Technology Associates (FTA) cards may be utilized. Samples from a patient include before and after bacteriophage treatment in order to assess the impact of bacteriophage treatment on microbiome profiles.

Standard DNA extraction methods are utilized. One such method includes total DNA extraction from stool samples with the PowerLyzer PowerSoil DNA Isolation Kit (MO BIO laboratories Inc., Carlsbad, CA), following the manufacturer's protocol. The DNA is isolated by column purification and collected in 100 μL of elution buffer (Solution C6).

PCR amplification may be performed, for example of the V4 hypervariable region of the 16S rRNA gene using primers 16SV4_515F and 16SV4_806R (Caporaso J. G., Lauber C. L., Walters W. A., Berg-Lyons D., Huntley J., Fierer N., et al. (2012)). Ultra-high-throughput microbial community analysis on the illumina HiSeq and MiSeq platforms. *ISME J.* 6, 1621-1624) each with 12-bp unique Golay barcodes, resulting in unique dual barcodes for each forward and reverse primer pair. PCR reactions are performed on extracted DNA using appropriate thermal cycling conditions, such as an initial denaturation at 95° C. for 5 min; followed by 15 cycles at 95° C. for 1 min, 55° C. for 1 min, and 68° C. for 1 min; followed by 15 cycles at 95° C. for 1 min, 60° C. for 1 min, and 68° C. for 1 min; and a final extension for 10 min at 68° C.

Dual indexed PCR products are isolated and combined and 100 μL of the pooled products run on a 4% agarose gel at 80 V for 2 h. The bands (~450 bp) may be excised from the agarose gel and purified using a QIAquick Gel Extraction Kit (QIAGEN, Valencia, CA) and eluted in 30 μl of elution buffer.

A sequencing library may be prepared using, for example, the KAPA LTP Library Preparation Kit (Roche Sequencing Solutions, Pleasanton, CA) according to the manufacture's protocol. High-throughput amplicon sequencing is conducted, for example on a MiSeq (Illumina, San Diego, CA) using 2×300 paired-end fragment reads.

Microbiome bioinformatics analysis can be performed using appropriate standard software, such as but not limited to Quantitative Insights Into Microbial Ecology (QIIME) software package, version 1.9 (Caporaso J. G., Kuczynski J., Stombaugh J., Bittinger K., Bushman F. D., Costello E. K., et al. (2010) QIIME allows analysis of high-throughput community sequencing data. *Nat. Methods* 7, 335-336).

All publications mentioned in the above specification are herein incorporated by reference. Various modifications and variations of the described methods and system of the present invention will be apparent to those skilled in the art without departing from the scope and spirit of the present invention. Although the present invention has been described in connection with specific preferred embodiments, it should be understood that the invention as claimed should not be unduly limited to such specific embodiments. Indeed, various modifications of the described modes for carrying out the invention which are obvious to those skilled in biochemistry and biotechnology or related fields are intended to be within the scope of the following claims.

P Embodiments

Embodiment P1. A method of treating or preventing a bacterial-associated cancer in a patient, the method comprising administering to the patient a composition comprising at least two bacteriophages, wherein the cancer is associated with infection by bacteria, and further wherein the bacteriophages target the bacteria.

Embodiment P2. The method of embodiment P1, wherein the bacterial-associated cancer is colorectal cancer, esophageal cancer, gallbladder cancer, lung cancer, squamous cell carcinoma, bladder cancer, stomach cancer, or MALT lymphoma.

Embodiment P3. The method of embodiment P1 or P2, wherein the bacteria comprise *Escherichia coli, Bacteroides fragilis, Helicobacter pylori, Salmonella Typhi, Streptococcus bovis, Chlamydia pneumonia, mycoplasma, Helicobacter hepaticus*, and/or *Schistosoma haematobium*.

Embodiment P4. The method of any one of the above embodiments, wherein the bacteria comprise *E. coli* and/or *B. fragilis*.

Embodiment P5. The method of embodiment P4, wherein the *E. coli* are pks+*E. coli*.

Embodiment P6. The method of embodiment P4 or P5, wherein the *B. fragilis* are enterotoxigenic *Bacteroides fragilis* (ETBF).

Embodiment P7. The method of any one of the preceding embodiments, wherein the bacteriophages are specific for the bacteria and do not target other microorganisms.

Embodiment P8. The method of any one of the preceding embodiments, wherein the composition further comprises an antibiotic (e.g., a chemical antibiotic).

Embodiment P9. The method of any one of the preceding embodiments, wherein the patient has been screened for a genetic mutation that predisposes the patient to cancer.

Embodiment P10. The method of any one of the preceding embodiments, wherein the composition further comprises a pharmaceutically acceptable carrier, diluent, excipient or combinations thereof.

Embodiment P11. The method according to embodiment P10, wherein the pharmaceutically acceptable carrier, diluent, excipient or combinations thereof comprises MgSO4.

Embodiment P12. The method of any one of the preceding embodiments, further comprising administering an antibiotic (e.g., a chemical antibiotic) to the subject.

Embodiment P13. The method of any one of the preceding embodiments, wherein the bacteria are characterized by the presence of a bacterial biofilm.

Embodiment P14. The method of any one of the preceding embodiments, wherein the bacteria are resistant to antibiotics.

Embodiment P15. The method of any one of the preceding embodiments, wherein the composition is administered via an aerosolized formulation of the composition.

Embodiment P16. The method of any one of embodiments P1-P14, wherein the composition is administered intravenously.

Embodiment P17. The method of any one of the preceding embodiments, further comprising administering in combination with an immunotherapeutic agent.

Embodiment P18. The method of embodiment P17, wherein the immunotherapeutic agent comprises an immune checkpoint inhibitor.

Embodiment P19. The method of embodiment P17 or P18, wherein the immunotherapeutic agent comprises anti-PD-1, anti-PD-L1, anti-CTLA-4, anti-CD27, or anti-IDO-1.

Embodiment P20. The method of any one of the preceding embodiments, further comprising administering in combination with a chemotherapeutic agent.

Embodiment P21. The method of embodiment P20, wherein the chemotherapeutic agent is 5-Fluorouracil (5-FU), capecitabine, irinotecan, oxaliplatin, Trifluridine and/or tipiracil.

Embodiment P22. A method for treating or preventing colorectal cancer in a patient in need thereof, the method comprising administering to the patient a composition comprising two or more bacteriophages, wherein the bacteriophages target at least one bacterial species that is associated with colorectal cancer.

Embodiment P23. The method of embodiment P22, wherein the patient has been screened for a genetic mutation that predisposes the patient to cancer.

Embodiment P24. The method of embodiment P23, wherein the genetic mutation is familial adenomatous polyposis.

Embodiment P25. The method of any one of embodiments P22-P24, wherein the bacterial species is *E. coli* and/or *B. fragilis*.

Embodiment P26. The method of embodiment P25, wherein the *E. coli* are PKS+*E. coli*.

Embodiment P27. The method of embodiment P25 or P26, wherein the *B. fragilis* are enterotoxigenic *Bacteroides fragilis* (ETBF).

Embodiment P28. The method of any one of embodiments P22-P27, further comprising administering in combination with an immunotherapeutic agent.

Embodiment P29. The method of embodiment P28, wherein the immunotherapeutic agent comprises an immune checkpoint inhibitor.

Embodiment P30. The method of embodiment P28 or P29, wherein the immunotherapeutic agent comprises anti-PD-1, anti-PD-L1, anti-CTLA-4, anti-CD27, or anti-IDO-1.

Embodiment P31. The method of any one of embodiments P22-P30, further comprising administering in combination with a chemotherapeutic agent.

Embodiment P32. The method of embodiment P31, wherein the chemotherapeutic agent is 5-Fluorouracil (5-FU), capecitabine, irinotecan, oxaliplatin, Trifluridine and/or tipiracil.

Embodiment P33. The method of any one of the above embodiments, wherein the bacteriophages in the composition target one or more oncogenic strains of the bacteria.

Embodiment P34. The method of any one of the above embodiments, wherein the composition minimizes development of bacterial resistance.

Embodiment P35. The method of any one of the above embodiments, wherein the bacteriophages are lytic.

Embodiment P36. A bacteriophage composition comprising one or more bacteriophages that target a carcinogenic bacteria, and a cryoprotectant.

Embodiment P37. The bacteriophage composition of embodiment P36, wherein the cryprotectant comprises glycerol.

SEQUENCE LISTING (6 sequences)

SEQ ID NO: 1 - DNA, 166431 bp, Artificial sequence
  Synthetic polynucleotide
  misc_feature: Ec20, E. coli bacteriophage
ttaggccgcaagggccttcatagttttagcgatttgggaaacttcatcatcactcaaagagttgcgataaccgatgaagtcggaaacaatacggaatttcttggtaaactcagcaaccattttatcactgttttttgaagcattatttgataatacatcaaaaagattagttactgtccagatatcatgaccgatggtatcttttccaccattaaaatatacaccgcgcaatgaactaactatattagcgagtcgtgtatattcttcagaaacttcatctgtactgaagtacttcatcataaaatctagctcaggatacttgataattttatcaatatatcgttgagctgaacttgaataacctacatacttatcataatctacatcatcaaaagcatctacatataaatcacgcaaagcttcaaaaatacattggcactgaccgagttcttttacctttttctgtaaaagcggacgaataacataaaattcattaatgccaataagattagccatacgaatcaaaatattcatagatggatgacaaagtgatgtagtaccatccatagagaaaatatcagaacgatgcatatacgctacataaccagtaatttcatctgcttctgacgtaagtgtaaataattcctctttttcccaacgcccatctttaatttcaaacttaaatgctgtagcagctttaggacgaggagctttacttttaactacctttggaatatagcttttaactaaagcttcaatttctgacaaataatgaatgttaacttcatcactttcaaacattgccataatatcaggtagtaaatcaatctgcgattctacttccggattaataaacagaagacgctcattgtgatgaatatttaaagtgttattaaattcactatcatctaacgcatgtgctaatccacggacaatattaacacgatttttaatattatcaataacgatattaatttttgttgtattaataccaaacagacgataacttgacgcaacggctgatgtttcatgactttgcttaatgcgcttcagtcgagggtcaagatttacttcatacacaactcctgcattacataacttactgtcaggttcaaacatactctgcatctttttatatgacagatttttagtcgtgaatttgactgaattactaatcatataatctcgagcagaataccccatcttcatcaattcacgatatgtgtgacggggagatgtagattctttaaatcgttttacatcttcattaaatgctttctcactaagctctttaactcgttcaataatatttttacgagtgcgatcatccagtgaaagagcctcgcgtgatggagcaatatccagtgaacccattggaaacttaatgtaattcacttcattgcgaatgcttagccagttacggtctctaataacaccatcgataggataaacaataccgccatagatagcatataatccaccacgatcaggccagtatctttctggatttacgccgtaataatcatcaaaatccggaaaatagtcaatttcacgatcaagaccattaatgatagccaaatctttgaacggtcgcatgatataagaaacttcataagcaaagtttctaaagtctttttcttcaactggaactacgatttcaataccagttttatcatctggacccatttcttttacgaatgtaggtttaatctgtggaccatcaccatccatgtaagctacataaccacgaattttacctttatgatacgaagtaatactaaacgtatcagtataactaaacggagatttagaacctaaaccaaatccgccaatgaaatcgttagattcagccttagatgaactgaagtatgaattatacaaaccaggagaattatcatcaccctgaatatcaaaatcactcatacccggaccaaaatctcggcaaacaaatcgtggatctaaacgtccaggaacttgaatgataaatttttcaggatttccattgagagcatgggcatcaatcatgttagtaatcaattcacgaactactgcgcgaatcttgtttgtatacaaatcagatgacagaattttaaatactttaggatttgctgcgatgctaaatgcttttgatttagaaccattgccaagaattgtttctttttcagtggtgataatcataatttcctcattaattcatattacgtttaataacttcagcaacttctagcagttcatctttagttgcggtgtcggattgaattttatctctaatatctttaaagcggtttttaaattcttcggcttctcccatatcgaaaaagcgttgaatgattctatattctcgatgaactgctttatcaaaaagttctaaatttactttatatgatttcattccaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactgggttttgaatcatctcacgatattcagatttttccaaagagccaagtcctttaatataacggatgctatgtttaggtagagcatctttggcactctcatattcagcgactgtataaaaccattcttgttttttaccgacctgagcgatgattacaggagttttgacgaagcgaattcgtccttgctcaaacaattctggccaattactaaaaaatccgagcagagaaggataaatgcttcctagaccatcgtggtcagcatcagtcataatagcaatattgcgataattcaagttttcagctttttcaccgagaactaatccagtgattgcgcaaatatcaaatagttctttgtttttaagcatatctgcataagacataccccaactgttgagaactttaccgcgtaatggataaccaccgtgaagttctttatcacgaacatcaataagatatccgatagcagaatcaccctcagtcaagaacaatgtagtatcagcatctttaccacaaagattcgctttgatatgtttatgaaccttagctttagatgcctttttagctgctttagtttctgctgctttttctgccgccaatttacgagccaaagcagcttcaataattggcatcagaattgcttcattattcaaaatagcacgtgaaatctttttagcatcaagctgaatatgactacggatttcaccaaatggagaagtcaaacgctctttagtttgagaatcaaatcgcatgtttttcatatcacgaacaaacataacgattgtcaaacattctttaacgcgtgctttagtcacatcaattttgaacttacgtttgatttgtggaataaggtcttcacaaatatcatccataacacagtcaatgtgatggccaccattcttagtatgaatgttattaacgtatgttaattgacgaaaaccatccggtgaacgaccaactgcaatagaacagttttcttgttcttgaacgatagcatgctcatcatattggcgtgcatatttcttaaaattgccctgaacctttttaccattaaaggtaaattgaatatcaggataaacaacagcaagtgtctggagacgatctaatgtaatgtcaagataaacttgagataattcattagtttcaaatgacataaaatctggaatgaaagtaacacgagttcctttccattttccaggaatagtttcccatgatttattttccatgccatttgaacaacgaactacaatattattttgaccatcgccagtttcaccgacaaacatcacagaaaaaatgttagttaaactagaaccaacaccattcataccaccggtgacgcgttctttatcatcaccaaagttaccacccgcttttggaatagtccaagcagcaactggaccaggaatttcttcaccggtaggtgttttaaccatcgcttgtggaataccgcgaccgttatcttcaactgttacctgattatttttaatggtaacattaattttattcgcgaatttaaacttagtacgaataccttcatcgactgagttatcgataatttcatcaataagcttaacaagaccaggtacatactgaacactttcccatttaccaaacagaaagcgctcatgcatttcattagcagaagagccaatgtacatgccactacgctttttgatatgttcaatatcgctcagaattttaatttcattcttaatcattacttatcctcgtttggtttcgggaatattatactccggcaatcataaagctaaaggcccgaaggccttttatttaaaacgaatagttgaatccttaaagaacaacccagaacatactgttccttctactttctgcccagtaggtccaatagcacgaaatccagtatgttggaaatcattttcagagcaaccgaaccagttatatccagtgatttcaatattcgtaaaaccacttgatgataaaattttagttgcattatcagcatcagtacatcctactaaagacactgctaatactaatgctgcgatagaacgattaatatatttcataattttcacttaaatttaatggcttgaaggagactaataattctcaagcgacttctttcatctttaactgtaaaagaaagagggtcaccagatttcatagtgatagtgcattcaaaattaaaatcaaaatcttcggaaacttctttgaagaagtcaaattcttcatcataaattagaacattactctgacaactatgaagaatttttccatcatttccagatgctgtactaatcatcgtaacattacgacctttcatatcttcaacgataaattcgcttgtagatattacagcattaatagaaccattcctataaatagcagacattagatatttcttttcttcgccttcgcgaatacgatacttcttaccgattttaaacataattaccctttaagtaagtcgtaaaaaccaccattcacatgcttaggagcagaaactaaccgaacagcaatccgatgacaatcaggacatacatcagtatccctttcagaaattttcttgattttttcgtattcttttgcgcagtcttttgattgacatttataatcataaagaggcataattattccttaaagtgagctttcaacatctgatacaaggaccatgcctgttcattattttcaatagtaactttcattacagggaattctgtaaaatcttctatctgttcttgctcttcctgctcttgttcttcagctgcctggtatggattttcaacttcattaaagaattcagcttcattcgttgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatctaatagccattaataaatttccttccagtaagttgtgccatcttcagtaatttcacgaaatacaccgtaaattggttgtttatcaccgactttctcatatacataaaccgaagtcaagtgagtaaacttgatagtgtgttccttttgaactactaccaaatttggatcaaataatacatcttcaaattcatcattagtgcaattctgaacaattttacgtttcattacaatttcctcattaattgaacattggagcgatgcgtttcagaagagtagcagcacctttggcgaattatccattttattctccaagttgttttctgtatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtacagcttaacaccgtcttctacccattgatcagtaatgtatgcacacatagcgcgagtacgctgaggaagtggttgtccaccttcggtaaattcaaactcataaggagcaacgaacttgatagcttgaccgagtttccacttaaaatctacacctacatgcgaagtatcaatcgtttcaattcctttagcgggaacagctttcaaaaacgcaggctcaagaaatttccatcgaacataaccaaactgaggtttagacattccatctttaggaatgatacgcacttttacttcagaatcttcatctttaacaccatgtttaagctgaatgcttacaacttcaaccaattttcctgctgccttagaacgggatttatcagatacacgagcaatttcaccgatattaatattcataattatctctcacttgttaaaaagattttatactccgcaggaccattatactctggtcccaagagtttgtaaactagcttacacgaacattaatcactgcgctgcgaggaactacagagtactctccagcatgaactacgttcagaagttcaacaccatcttcaatccactgatcagttacccaaccgccaatcggattcgcgaatggacgacgaatataaactgccttacacaacaaatcagtcgggtcttcaattttttcaactggtgttacatacatagaaactaaatccatatcaatatgggatttttcttgttcttctttttcaatttctgtcaataaattgaaatcttcttcatagatgatgaatgatgatacccttccataatagtttctaatttccatgtacactgtaccaatgagaattccgctattaacactaataacagtaaaaggatatccgccagttgtaccaagaagttcccaaaacttgctatcagtcgtattcgacattgtctggaaatcaatttcagatggttttttcatttgatacgtagtattaattttaatcataattttcctttaatctaaggtaataaagccttttaattcggcatgcgatttgcgaaacattacttgatgcccaccaatgataacttgatcatctggcacttcataaatcgcaatgtacattccacgatcttttaagtcttcacgctcttctcgagtaaaccatctcattatatcatattcactagcgaaagcaaaatgatataatgcaataaaccacaatggaatataattttcaattcgtgaataatctttattccatttagttttaatagcatcattagcattttcaactaataacttatcatcgtgtggaataggaatactttcatgactttcatcatcattgcaatgatgatgaaatgatgatgaattaataccgcaaaattttagccaagttcgagttttcatagaatcaaatccacgataaggagttgattgaacacataactcttgcctaattttcattataccactatcatcatttaatgcgctaaacgatgattcaacacgataaattttcattttattatcctcagtagctatggtgttataataccacaactgaccgaggaagtaaacaactttttatcgttttgttggaagagacagaggatcgcattcttcctctgacggagcatcttcaagacccatagcatagcgcaaagcatacttcatcatcaggatgtctttcgcacagtcatgaatagaatcatgcgcaacgaatccatctaaagttccttttggaagaggacacgtggtcatatcacgaacaagcagaagtgcttcaattctggtacgaatatcacgctgattccagaatttacacggttctaacttaaatgtatcaagctcattctcggaaacgccattaagacgttgaatatcgcgaatgagatcgactaaaattggaaaatcaaacgacattccacggcaccagccttgagatttccaaggatcaatattatgcgcattgatgtaatcattaaattttgcaataccatcgatagtgcttacatcttcatctgatggtgcaatattttttcgagcttcaggagattgattcttccaccactcgatagtacttttagtaaaaagacgatgtcctttttggctttttaaatcaaatttgattttaatgccgcgtgaaactaattcatcaaatgtttcaaccacttctgggttagggtcaaaagcaattacagccaaatcaataacagctgctttttcaccgcttcccattgtttcaaaatctataataaaatcaaacattaaattttcctcgctaaatcacgaatttgacctacagtatagtcttgaatataaactttattgataggctcatcaataaattttgccatagattcaatgtctttttgtatttcttcaagactgtatactatctttaaagctttttcgcgaatagtaatattttcaggaccctgattttcttcaatgacagctttaacatttgtcataagagatttaaactgataccaatttaattcaatcattaataatcgcctcataaagatagctaatttcgcctaaaacataatcattaattgtaacagttttcacttcaccacaaaagaattctaacgcaattaaatctcgttcaatttcttctaattgaagcatcaacttactagattcaatttttacagtttcacgatttttaccatgagcaatttcataaatttcgctaactttatcctgaagaagataaaactgatctttagttatttccacgaatagcttcctcaaatttaattagtaatttacagacactttcatctagtgtaattaccgtatctgtattactgtgatatgattgtttttcaattcgtttaattgctaatatagtatcacttataagataaagcttatgaaggagctcagctcctgttaccataacatcgagattatcttgcttattagtatgcttccttataccatctattagacgatttaaatattttgaattgatgttaatcatatagcctcacacataaaatacatcataacgaccacgagtgacaccaacataaagaagctgctgagctagttcagcatctgcataatgaatacaaggcgtataaatgaaagcacggtctacagacataccctgagctttatggaatgttgatgcaggaagtgctttcactttactaaactgtgatttagcatcccaaaaatcactccatggagcttttccacccttattccagtttttataagtttctgctgttttacctaaaaataggttaaacttatatagctcttcatcagatgaaattattttaatcttttcacgataatattcatcatcgccgtaagtttctactgttaaatcccaatgacgaattaagtattctccagaaacaccacgagctttaacaaatgttgatgtatactctgcttctataatacgaactaattgtccgttattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagagatttgacgattgaaaaataatttaccataaaatcgcgtaaagcggtatcaccagtaaatccacgtactccatgcccgtcaacaactttatcataaatccacttaccgttacgaacgtcagtagctacatcaataataggagcattactgcgtttaacttcagtgagttcacactgataaaaatctttatgtgtaaagaatggactgatataagcagtattttctcctggatcaacaggtctaatttgcttattatcacctattccaattatagtacaccaaggtggaatagttgaaagcagaattttaaatagctttctatcatacattgacacttcgtcgcagattaataccctgcatttagctaaatctggtacttccttctgttcaaaaagaacgttttcttcatacgtaactgggttaattttaagaatactgtgaatagtactcgcttctttccccgacagttttgaaagaatctttttagctgcatgtgtaggagctgctaaaataataccagtttcacccgtagatattaaagcttcaatgatgaacttagtaagagtagtcttaccagtaccagcaggtccattaatagttacatgatgtttcttttctttaatagccctcataacgatgttaaaggtatttttctggccttctgtcaaatcatcaaatgtcatcggaaagtccctgcaattggaatactaacaatacgcccagtatctagaattcgttgatataatctttgtgtatctacatcaggcttaacatgtttaacttctattttattaaaccaaaacttgcgtggagtctcaactagtcttggaattcccatacctaaagctagtttatattggtctttgagagtagtaaaaactctatcagcaatctctctttcaaaaaacacagcaggacgatgttcatcaagtggaactggcgccgtaaatccgtctttgtctcggtaaactatcgcatatacataaaccatattatcctcggataagtttaaaaattgaacaatttagcgggtatcctcttttcagtttaagtttatcaataaaagacaaattttgataccgctctacaccttgaataattttatcacacatatcatattgcatttctgcttctgacagctttttcacaattttccaatccgagcctttaagaagaacgttcaatttaacaacttcagcgccttctgctatgcgagaaccatcaatacgtgctttaagtgctataatccttagcttaatgtcagaggtctgttttgatttagaaagctgagaaatatgttcaattcggttttcacgttttttctgtatagctttaatttgattataagtctttttgattttagcccatttcttttcatctaaatttagtttatgaacttttttcgcagatgaacgaccaattcgcaaagcaaataaatcacgcttttcaatcaactcttctaaagtataatcagaacgaaatgtattatactttttctttactgcaataacattccctttaatgtatccaacgttattatcaaaacgttctaatgataatttctctccttcaatacgattatcaaaaggttctcccgagtaagcacaaactttttgatctaaaatgttcttaatgtaattgaagtctaagttaaaatctttagaacgtctttttgcagatgcctgagtatgctctaaacgacgtttaattttacgaatttggttattagacagcttcatatttttctcacatcttacggacgattgactactatactataacatttttaccttggcttgtaaacaattttatgaaaaatgcttcaaaaatttcatggtataatgaatctaagtccttccattatagattaaatccttcaaaatcaagagtatagatagtgtatgttgaatactttttatactcatatctatctgcaattctaaatacacttccagctggtatcattacttcttgttcatctgaaactaattccatattacgataacgatggctatccggaaacttaaagtttggattgtattctttacagcgtagagcttttatagcatactcctggaaattgaataccataggagctttgaattcaaaaataacctgtgtgttatactctaaaccggaagcaaaatgtagagctatatttttatcatatgaagctgatacgactttatcaaatgtaataatatcaattccttgatttaacacctgcttagtctcagctggaacacctctccaaagaggtttatcgtttggttccaaacgagatttgattatttcatttaaccaagtatggtcatctggcttattagtaatacaatgaattaaaagttcaatttcagataaattaaacccttcagaaagtaattcttcacgaatagaagcacgcaccgatgcatccattgattttattttaaaatcttttagttgcattactgagtatttcattcaactacctcaatatcataaactttaaatgttccaaatgaatcgtgtaatttttcttttgaaatagaagttattctatactttccaattggaatcatccattcttgttcatgtacaatcatcattaagttatcagttctttctgaatctaacccatcagtatcttcatacgtgtacttaaactcagtattaggagaagaaagtataatatcgctgatatggtcagagtaattaaaagctttatcagtttttaaacgaagtattgtttcagtgaaatattcagcataagaaaaagaacacgctgtatgcaaactagtagtaaatgaatctaccctgttcgttgaaaacacttctccaacctgtaaatctttaataagttcttttgtcgattttgatataccacgatatagctgataaggtgatttagttaaatgctttttaatgattttattcaactgcctatgaagagcttcattctttttggcttccatacattgccaaagaactgactgctcaaagtcagtaaatttttcacagacctttttatacatatcatattgaaaatcaacgctttcagcttttatagataactgttcaacatctgcaggattaataatcatgatagcctccgtatacttcagaagctatcatatcattgttagaaaggaaagtaaacaactttttgaattattttgcccaaggagcccaaggcggagggtcaagatggtatgaagctagttcttctagaagagcatctggggcttcaattccataattctgtaatactatacggtactctttcttataatcactggaatcattctggatattcgtagaatgattatcttctaacatctcaaataaatccatactaattcctagcgataaaaaccaaattgacgattagcttcaataatctttctttcttcttcggacattctccagcgtagtccaacatcaaaatgagcccagaccatcttaacaaatgcatttatatctttaatatcttcaataatgaatgttttgcttttaaaaggctgactcgctaatttaactttatcatcttcaaacaggtcaaaaagaccatattcatgagctcttttatagcctttaatagttaaagcttcagaagaagaaaacggtgaatcagtattctgcaaaatatcttcagtatgctttataattagaataacattttctggatattttctttcttttatatcttcaattaaaaaatccggattttctgctaaaggaataattaatgagcattttttaccaagagtatttactgatttaccttctttagacatgaattctactgaataatgttttgctacttcaatcatgtgatttccttttgcctactaatggaccatcgggaattttgttttcctggatatatttctcattttcttccatcattttactgccgattttaagaagcaaattcagtgcttcatttgcttttgctttagcctcttctaacgttatatctttgttcatgatttatcaccatagatgtctctcattaatttaagcgctgagcgttctaatttcttttctttctcagcactaatcattgatttcatccattcttccgattcgttctgcatttctttatttgcttgttcaacccaaccatcatcaatatacatcgagtttggtctattgaaccattcaagcatcttcttcagagctttcatttgttttacctaaaacaacagtaggagcatcatcaaattcatgaattttgagcaaatttggatgtaaactattccatacagaagaaataaagtatgataaagcatcttcactcgcaattataaatttatttcctttatctattttccaactatatactgaatcgtacgaataaaaagataaaggtttattattatattgttctgcgctaacattaatgtattctgatttagtaaatgcttcaattgctctaaacggaatatttggtacagtttcaataataccaatctttttaagttttatttcagcatcttctggaactggcattgaaacgaaattttctacgagatacattgggtcacaataacccttatcaatcattactgctacggtaattggaacgtctttagcaaacgacatactattactgctaatatacatttcaaacaaaatcgcttccataattttcctcaatcacaagatgtagatgaacaactagaatcacaagaacttccacatgaatcgccttcccatacatgaacaggaacattagtatcatatgaatcagaactagactgtgtattctgcgtattagatgatgtagtaggtgttgaccagcgccaaggatttttataatattcttgggcttcttcataagtcatagtaactgcttctactgttccatctcccatataaacatactcaactacagttaaaggaaggtagtcatttgaaataggaactacaccttccccaggagtcgtagagaaaaaatccgtaaagaaacttttaaaccaattaaagataaacattacaaaaagcctctcttgaattcgacatgcttttcaccataatcatatcgaatctctgcattaaattcgacagaaccatctgcgtacatcataaatgaatgcacaacaacttctgtagaccatggctgtagttcatatttcttcattacatgccgtgaaatgataatatctaaatcttcatttggtttaatccaacgatttaacatagtgctctcctctataagataattctattataccatactcattttggaaagtaaaccgtttaaatgaaaaaaggactcccgaaggagtccttgaattattaaccacctatttctgttggcgtaaacattgcagcattcttagttttccagtcagctgcatcagaaactacagtagaatatgctgccttttcagaaggaaaggtctgataatgagaatctgcaatacgatgctcgttagaatagatttcaaacggaacagaaacttccatacctttaacttctttgccttcacccgctggatgagtaaaggtcttgatgttaacgaaaccacccataataaactcctttattgtttaattacaggtgtatttatatcatcaataacctcggtcttgacgtgcgaaattttcggcatttttcaaataataaagtttaaagatttcttcagccgacattccaagagcaataaatttattcatgaaaaagtgaaattggtcaatcagttcaaatttaatttcaagctgatcttcgggagataaatcttgaattttcttggattgcatttcagaataacgtttcttccaaggtttccatacagcagaagcttctttttcaccattactcataccaccaagagaagtatatagctcgcgagtttcgtctgcgatataatcgtcttggtttcgcaaccaagcaagaacttctcctgcagtttcaagtgaatcaggatgacgatttgtttctggtttatcattagccaaacgaatctgtaaatgccgctgcatgtcaagcataacctgcagtgggtcaatattgtgcataatattctcagcatatgcacgatttgctttatcaacaccttcaatcaaatgagcacattcattaaagtgagccattatttttcctttcaattcattaataagttaaataattatatcatttgaatatgtaagcaattaattaaaaatatatacttcatcagttccattcttttctttggaatgatatatgttaaagacgtattttttattaagatgcttaacattatattttttagaccattctttaagaagagtgttttcctttccgtgatgctctaaaacattcgacagtccaaattttattcctctgtcatttaaagaatctaaaagatttaaaaggtctttttcttcttcttctgaccaaaatttattataatcagcaactgttataagatatggagggtccacatatacaaaatcgccgtctagaattttgacatctttaaaatgcaatgaactaaagattattttatcacaattttgtttaaagtgattaaagcgcttttcactatttttgtttatagttctttttccaaacggagtagtaaaatttcctttatcgtttatacgaatcatattactaaacccgtgaaaatgaagaacataaagtaaaagaggatctctagttttattataatcttcacgtaatttcaaaaactcttcttttgatgtttttgatagtttgtattgctttattacttttaaaacgtcatcccatgatacattaataagacgcttatacatttcaataattggttcttgaatatcattggccaatacaggaccattgacgttcaaagacactgataaacctccacaaaataaatccacaaatctgtcatatttcggaaagtgaggcttaagttcaggtaataatgattgtttattacctgtatacgcgatagctcctagcattatattctctcatttattgcagcaaaaaatgaattatacaattcttcatcatatgtatttgatagtaatactaacacgttttgtgatttagcatattcattaaaccttgcttggatggttggattatcagtaaatgattctctttttgtccatttattacgtggataatatccgcatggcaaaaaatccaatatcatcaatgacacaggattttcagtttttgtgtattcttttaatttctctttatcttctaaatatattccaaccgaatcaatagctgtacctccaccaacttggtgtttaatttcaattatatgctttttaccgttgcgagaaataacaatatcaaatcttctagtacgcttcttagttataaaattagagcaaaacaaattatttgatttttcagtatcatcggttaaaaccattttttcttgataactaactgaacaatcagtgaaatattcttttactttattaagtatgaaattttcaactacggcagatattttatatgaatctccgtttaaagccatttcatgtacaattttattaatcattatatcatcctcagcaatttattttataataccataacaagctgagaaagtaaacaaatttatgataaatattaatttaaaggaggatatatggtacaaaaattaatggcacttgttaatgccataaaaggtaataagaaacgtatagcttttactatttctgctatggtaggaattttactctggaactttattctatcacctgttgcaattgcgcatggtattaatattccagtagttactcttgatacattcgtagatttagcatttgctttagttgggttaatttaaatcttggcatatttagatagccgcattttagccatcaacccctgcgcaatattatttttcatatattccataatttgttcaggggttgcaccttcctttctaatcatatcattaacatcttttgatttccagggagatttatcccaaaacataaccctttctcctgcatcaactaatttagtcattcgcttaatagtgtcaggatgacgaggttcattatctaaaacccacactcgtctatctttaaatggaacaacttctaggtctaattgaccacccgtaatagctataccattttcaataaaaagtgaatctataggtccttctagaacatatacatcaccatctttaactcgttcgactccatagatttttgttgcctcaggataagctttgatggtgatatatttttgaggagcatctttctttaatgcacgtccttgaaaagactcagcttttccattagcattataaattggaataacaagacgaggctcagaaatttcctttttgtatgttcccggtgctatgctattaactaatttaggccattcggttgtaaaccaaagatatttccatttatcctttggaatacaacgagcttttacgtattttataattggatggtcttccgccagtttatctaatctaatgcatgacggaagagatttaattattttcttctcaggttgtttaggaagttctttaggtttttctactggacgacttttacctttttcttttcttatttcaaagatatactcacgatataaatcaggttcaaactcctttaaatatattccgattggcgcatgatagttgcagttataacaatgaatatttccttcattattatcaccataataccatccacgggctttattctggtcggtttttgaatctccacaaacagggcatctaaaccgcaatttaaaagttgaactattatttacttgtgtgaatttaggtaaatgagccaatgcacgatacgcaaactcattatcaatccaaggtattgatgacatttttactcttctttttctttagattcctcttttttctttttaggaatctgttcagggcctttatttactacagcacctgatgttgttccagtagagatattttcaggattaccacctgaatctccagcaaccatatcttctttgataaattctttatatgttttcatattaacctctattcataaaagcattaaaaataaagcattaaaaatttggtcatcaatcgatggaatagcaaccttttcggcatcatttagcaaatcattaatttcatcagatagcataacacatgtgcctttatttcctgtaattgttactgcacaattacgaacgttttctttatcaaattttaggttaatattttcgtagtgaaaatcctttaatgccgaatatatctttaaaatgaaattgtcttttactacaataaacccaacttcactattaaaacgtggttcatggaaactgtaataaaccttttcatctataaaatcgtatgaaattttttccatttttaaatatgaaaattcagaactatacatattaacctctaattactcacctaccacttcagcgatgatatttttattattaaagtttttatcacaatacagaacgtaattgtattgcattacaccaccagacttaagctgtttttgcacttcagctttcatttcagggcgatcgcgctcaacgatattcataatatccgcttcaatttgagtttcaacttcagtctgatctgcagtcatagaccactcacacaaatctttgtcataacccgccatagcaggctgagcagcgcaagaagataaagcaaaaattgcagcaaagataaattttttcatgataatctcctcagtagtttatgtttatatagtatctcaatttccaacaaaagtaaacagttattttaaatttctgcgtaatcacatgttacaaactgtttctctagcttaacgatcttacgaaaataccttttacactgacgaatctgtcgcttcgtaggacgtacagcaaacttaataaattccactcgaccaaatggaggactttcttctgctggaatatctaacaccaattcccacgtatccgcaataagtgctttgaattgagtatttttcctgacgttatacggagtaggtttaaataaaacaatatgcatattatcctcggcaatccacttcacatactttcttgtcatcaatgaaagctttaactaatgctttattaacttcagcatactgagtagtagcccattgaacgtcatctttcatcattgtggtttctttagtaaacatgctttcattcttaaaccgccccataaaaactacctttaccaattccataacaatctcctcatttaaccaacaagactactataccatagtcttgtcagcctgtaaactaaaattttaattcattcgccaaagcatctaactgggctcgggctgattcatttctttgatagcgattctgttcagcctgaatctgttgtgaacctgctacttcactcacttcggttggagtagaatcttgttcaatttctacccatttttgatttcctttttgaacacccatcaaaaacttattccacttattcttatcaccatatcgtgatttgatttgcttaataagttgttgttcagcagctgctagctcctcggtttcaatgaccgcaagcataaaatcagctgttgctggaagaccagcagattctgcgatatcactcatgttaacatcagaagagtcccaagcttgtttaccgacctgtgctgcagtccaaagaacagtttcggtttcaacagccagagcacgcaattcctctgcaatagctttaacagttgtgtaactattttctgaataaactctaatgcggcaagatttacaaatacctagatagtcgacaataatgattgttggaacaaaattcttcttgagctttaattcatttaaaagcgaccgaaatgtattagcgtctgcttcaccagtaggatactgtttaacgattaaacgtccaagagtagatttctcacgccatttttccatttttcctttatattcagcgtaagaaatatgcccatcatcaatgtcatcaagagaaacatcaagcatgttagcgtcaatacgtttagcacagacttcttctgccatttccattgaaatgtaaagaacattatgaccgagctgtaaataatctgctgccaatgaacacagacctaatgacttaccaacgttaacaccagccattaaaacgttcagtgttccagtctcagctccgcctttagtaattttatttagaattttgagtttaaatggaaccttacgagctttattcatataagatagccaacgcgcttcatagtcatccatccaatcatgaccaacgtagctatcaaatgaaattgataatgcttggcgcatgatgtcaggaatagcacctacatctggcattttcttatttcgtttttccggaggaagctcagcattagtttgaatttcgattattttagacgtagcattaaacatcgccctttgctgaacatatttttctgtttcttttactaaccagctgtggtcttctggagaatcagccagttttgaaataagtgtttttacaccagaatattctgtttcagtaaatgaactattttctaatgcaacatttaacgcattaatagatggaacgctatgatactcattaacatgagatttaattaatttgaatgtatttttagctggaccactttcaaaatattctgaatccatatatggccaaacttttgaaaaataagcttgatcaaatatgagatgagaaagaataatttctaccacacttactccttaaaagaatttaaattttttctttgaccttttattaaatgcatcttgcagttgcattgtaatacatttttctacatgaggagctaactcagcttttctttcttggtcaagaacagcaaagtccattacaacctttccatcaacccaatctaattttgtcacatacacaatgtgtgtagaaccatcttctagtttaatgacaatctcctggataacattttccatggcagatttaattatcttaagagattcattaaaaagacgttcttttctttcttcttccccctccgaagagggggattcatcgataatttctaaatctaaatcatctttactcattaaattcttccatatcacttaactgctcgaggtcagtttctaaatcagcagctgatttacttttactttctggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttagtatcttttgcacgccaagatttttcttcgcgaatcatctcgccggtttcttcatcaagaaattcacgagcataccagccatttttaggttttaccacgaatcctaattctagagccatatctaacaatccagaataaggatcgataccaccgtcaaatttaacatcaataaagaatttacttttttctttaacggtacgagatttttctacatttagaacaaattgatacccttgaagatcagaaccatctttaatctgacgtttaccgataatgaatacagtatcagccgaatacattacgcctgtaccacctgtcatcacggttttactaaacatttcaattgtttcaattgtatggttaaccgcaacacatggaatatttttaatgctaaaataaggagtaacaatacggaataatgacttcagtgatttagcacgagtcatatctgccacagatttttcattcaaggcatcttccgtttctttcttagaagccatattaccgattgagtcgatgaatacaataaccttttcaccacgctcaatagcttcaagctgattcaccatatcaattttcagctgttcaactgactggattggcgtatgaattactcgttccgggtcaactcccatggatcgcaaataagctggagtaataccaaattcgctatcatagaataaacaaaccgcgtcaggatatttgttcaaatacgccgcaaccatagtcaaagacatatttgatttaaagtgtttagaaggccctgcgaaaatagttaaaccagactgcataccgccatcaatcgcaccagaaatagcgatattaagcattgggatttttgtacggattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacgataaatttaggcattaatcaactgctattggatgaatagcattaaacttatgaaatgcttctgatttttctttacgtgaaacacacatgcgaagaacctttagtggttcatcttcttcacccaacgattttcgtttttcaatattagaagttttccaacgagcttgctctggaaactctctattgatttgctcaagcgctctattatgtttagaattactacgaattgaactgcaccctccaggagcttgtgcttttccagatacaaccagatatttgaacaaggccaaatgcggataaccttgattaattaaattgagaaatgcatacatatcttcgcacaaatcaatttttccatacccaatttgttctgtcgtaagttttccaaggtcataccatgtattcgtgaatccatatgaattttcacgataattaccccaagatgaagtaattttaaaaattggtaggcgagcatgaccgtgataatacccacaatccatggcatcttcgacgtattgaatcaattcatagaactgttcacgagtcaattgattgactttatccacacaacgacgatcatctctttttcgcattgaactcatacgaatagtagtatcatcgtcaatcatccagattcgttgacctgcatacatatcagtaattgctttacgagtaccggcaattccattaacatcatcaggaatagttacaattttagctttagacccataggcatcataataagctttttcttcatgttcacgtactacgatatgaggttcataatcagtcggaaacatatcaagggcagaaactgcccctacacgttgatagctcggaattacgaattgaatcatttaagtgccttacatttgtcaaaatggtatcttgtcatatttggcccacgtccttttagtccgcaatgcggacatattttttctatcaaattatgaggttttcctttacgatttttagacatcgtttctttaattattttagctttttctacgccaaaaatttcttcataagttttaccagaattttccttggctcgatttataattccatatgcctgctcatttttaccatacattggattaccttcgcctttcattcttttagaatgatcaggacgcttgattccacgaaaggcatttccgcacttatatctttcttctggagatagttttttaccgtacattccatttaatttgcctggaaaacttcctccccatgcttcattctttaaattatatgaatccggacaattagcagcatctaaacaagttaaaataatttcttcaacctgtctaaacattggtccttcatataatatttctttattaaaggattttattccatatttctttttagcatgttgccaaactacacccgaaccatcataattcgggttgtgaccatcatgacttcctatataccactttttagttttaggatgtttatacttataaacatgtggcacatttacttccattttccagtataatcctttttagcaatatgagtctcaccggtgttccaccaatggtcaactaaataaaactgattttcgtacacatgaagacttccaacgttccatataatagaacctgctttatattgccgcgatgggtcgcctgcattcaaatcagatactaatttatctagtacgtatttttgccaagcataatcattacgatagcctgcccagcaatcattgcttctcatgctaacaaccgcattgactttcttatcacgaatcaggtactgtactgtattagtacacatgaaatctgacataccatctttattgtagtcaaattgcatggatggacgagtataaatcatgataccacgtcgagaatcaggattttgaccaagttcagctaaacacatatcatattgagcatagttatcttctgaccaaatagcccaaccataattcgagttaatttcacctttagaagatgctacttgttgccaaatcttcggtgtttcacccggaatatctttaacgaacaagctcttagatttataccattcaagttcacgctgaatgtattcatcattaagagcgccaaaaataaacggttcatctgctataaatgatgcgccaataatttcaatagttttaacgccagttttatcaactacgaaatctttttcctttaatgcaagccccaaatgaagacggatttcttcaactgtcatagagtcactaatcatttaaacctcaattgatacattcatatttaacttgtaacagtaataagctccaacctaaaataatagttggaatcataagaggaaccgttacactatagtatatacttattataaccatcaagattaaaagcaatgctgctataattttgcttttcattccttctctctgatgataattacctgatttggctgcgcagactttttagtttcacccgcaattgaccaaatgaatgtaataaaccaaccaataattgaccaattaaacagtaaagatgtgaaaaagattcctactgtcgattttgacccacgcatcaaggcgataaaccatggaagcatgtatataataatagccaacacacctgaaactaaaaccataaaaattgaacctgctactaaagtttccatgttttcctcacttagtcaaattttttacgcatgaattataagaattcactacatactccatcggagcatttttacctgtacgccactggtaattattagcccaatttgcccaaagctcggcgcagtaattttcaattttttcttcgcgtgtaattacatccgaattacgatatgcttgagcagattcatctggacgaatagcctcgtcaaaattcgcctgcatttgttctactgtttgctttggagcttctttataacacttgacattaggattataaaatttgcttgaacagtttacaatttttcctacatcagactgatttactaccggtccttgagctacacaaccagtaagacctaatgcaataaccaaaatagcgattttcataataatttcctcttaaaacttaacaaataactttaaagcatcttcaattttaattccttttcttacacccataacagaaattggctgtgactgaaattttcctttaccattataaatttctaatccagtcaccattccattttgttctataataccgtaagtgttaccttcattttcaaattctttaactttaaagagtttattagctttttctgcgttaacaacttttaaattttgaataaaattagtttgaatatttttcattttgtgttcctccgtagttgatagttgtatagtaccacagaggaacagtcttgtaaacagttttgtgaaaaaatttttaatgaatccaaaaggtccagaatcatctgtttttcataagtatagatttatattacttgtatgaaaaagggacccggaggtccccagatttattctatcagccaaacaggaagtctaacgaagctttttcttcatagtccataccagccgattcgcacatacccgcaagcggtttaacaaacgatttttggaacaaagttgagtagtcaatccaagacagtacgtcagaacgaatttcttttggaagttctgtgcccgacggccaagcaatacacttgtcaccaaatggatttccttcacgtaatggaagaaccattaccttatttccatccaaaattggagctacacctaaaccgctaacagctcgacgataagttagcacaccacgaatatggaacgggcatttaaatcctggccaacctttatcatcatatttcgctatatcgttcgcagtttttacttcagcaataactttatagtcaagttgacgatattctttctcgaagttcttgtaatattcttggacagactcttcgccttcctgaagaatacgacgaatactttcttcgagagcttcttgtactgcttttggtgttgaactctgctgagtttccatacccatgatttttagatgcggttcagcaaatcgtttatcttccatatcataaacgttcagagcataacgctttttcgctttccaaaatccaccaacaccctttgaaccaagtggagggcaagaaatagcttcacggtccatatgcatcagatgctcgcggttattcatataatcacataactcacgatatgcaacatcaatcataggttccatctttttcttaccgaactgattcatgaattcaactaaatcgttctgctctttgaatcggtcaagacctactttttcaataactttatctacacaaacatatactgaatcagtatcacctgctgcaatgaaatcttcgccattagttccgcatactttattcagatattcattaattttacgagcaatccactgaataccgacttggccaaaaattgtgatagcagtagcatttcgcaaatcatagtaacggaaatgaatattaccaagagcgccataaagactgttaatgagaattttacggttcagctgatttgtattagcaagtgtagcagctttttcacattcttcaatcagactattgagaacagattcggtgtaattcgacagttcatttaaaaaatcatcactgaacttaacatatcgttcaacttcaggtttagttgaacaagaccctgcgcctttcataataatctttttaatagcttcggcattcatttcttcagcgaacattttctttttccagtctttacgctggaaaaatactttagcgatttcctttggaatgataccttcttgatgcttatcatacatccatccattcggagaacaagaatattcttcacttggcttaggagctgttcctgcgatatattcatgaattggatgaactttaaattgcccacgaatagtctcaggactaatgttaacctgacgaataatgctcggatacagagacgtcaagtcaaaactcataatatatcgacgagcaattggtttaggttcaaatacaaatgcacccggaaaactttgtttaacgtgcgaaccttgttgaggaataaccttatgttcacctttcagtgagttaaaaataatagcatcccaagttttaataggactcattacaccagaaaaaggcattttagcgtaataagacatacttaaaactagatcgataaacccgcgaattttatcaattgcttgaactgattctacgtcaatgatgttataactaatgtatcgttgatgattagtctcacgaagtttattaataggaccgtcgtatggtaatttaccttttttggtttcatgctgagcaactgattccaaagagaatgacggcaaattagtaaatgcgaatttcttatacaaatctaaataatcaagaatagatacgccatcaatagaataaatttctttgctaccgtacatattttgaattagtttagattttactcgaccgattggagagaagcgtttcatactgcgttcaccgagaaccattttaacgcgattcatgatatacggaacgtcaaatccctcaatattccaaccagtaaaaatagcaggtcgtttctgttcccatagattgatatattccatgagcatatcacgctcattattgaatggcatataaattactcggtcaagaatttcttgaggaacttcatcaccaccttcgcagtcaagcttagcagctaactttgcatcccattttgatactgagccgtacattgaattcaaaaggtcgaaaacataaaaacggtcatcaattgaatcgtaatgagtgatagcatcaatttcatattcagctttcattgggtcaggaaatttatcaccagtaacctcaatgtcacagttagctacacgaacaaattttcggtcataaacaatttctgaaccatacgtatcactgatataagcgagtttaaaatcgttcataccgagagcttcgagaccgatgtcttccattcgcttcatccaatctcgagcatctttcattgatggaaatttttgaggagcgcagtttttaccatagatgtctttgtattttgactcttccttacaatgcctaaacatagttggaagatattctacttcacgagtacgttcctttccgttttcatcaatataacgttcaacaatgttatttccgactgtttcaatagagatataaaattctttcatagatattccttagtttatagcccgagttattaggctcttgatatattatactccaaataaggggccgaagcccctttgctttaaatttctattgtacgacgcgatataacggacttgccatctttatttgcggttttgataatcgcatgaaatgcgcgttggtgtgggtaaactaatcgttggaattctttttggaattctatttgtttatcttccgggaggtcaaaaaccagttgggtagaagacagaccatatgtttgttttagattttcgaatattagaaaagcttcggtaaactgaatctctgattgcgtcatataatttgccttaattaccaatcgtatatttaggaacgagtttccattcgtgtttttgtttaaaagaaataactcggaagttattggttaaatctttcataaaagttctttgaccaggaacgatttcaatcagcccccaatcttctaacagccacgcaatcgaatcacgacgaacttcatcttcttctgtcatttcaacctgacggccatccatacgaagcatttctttaaaatgaacgatatagtatagtccttttttctgaagaatgtggcaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaaaccttttagttcttttaatactaaaggaagttttccatttttagtaagaattgatttatagttaattgcatcatttgtattaacttgataccgcttagcaagtaacttaataatcaatacttcggtggaatcttcgaccagttttgcccatttaccatatcttttaccacgaggaactgcagccatcagataattaaaatgggcttcatcacttaaacctgatccaattaaattcatagcatatacagctggcatgcactctggaaattgtgataatgcattctcaaccatgtattttgaataatctttttgagcaatagagcatttagttttattattaatagctccaattatttcaaaaaattcattttcagctttttctttaaaagaatcagcagcggattggacagctgtccaatcttttgaataccaagcaacttgatgctcgtttaattgaatatcatcttcaaataagctcatatcacttccactgcatttcgcacgctaattgaatgaaaagataagctagatgcaattcagtattagctgcaataccatgatactgattattttcgccgacaatttcgtacatacgaataatactctgtggagttacgcgtgtatagatttcttcggcaagtttaccaacaaaccaagaataatctgctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttgcagatttcagtcaatcgacgaatcatctgcttcatcatttcaattttatcttcatcggtcggttgaccgaatgtaataactcggcagcgtgactgaagcggtttaataataccatcaatattgttagcagtaataataatactacagtttgaactataagcttccataaaggaacgaagatgtcgctgagattctgctaaacctgaacggtcaaattcatcaatgacgattactttttgacgaccatcaaatgaagctgcactagcaaaattagtcaaaggaccacgaacgaaatcaattttacaatctgacccattcacaaacatcatatcagcatttacatcatgacacaatgcttttgctacggttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctctattaaaaatcgtgggtagaatcagcttcaagagctactacataattcgcatgttcaccttcaaatttagcagcgccttgtttaccttttgcccagagcagaagtttataatttcctggttgcattttcatatttgccatattgataatgaaattaaatgtattttcaccatcataatcaccaagagtcaaagaatatttaacacgggtcagagcagaatcttctactttattaaaaccgttaattacgattttatcttcttttaccgtgatagcaattgtatcaatttgcagaccacgagatacacgcaatagttgttgaaggtcttcagctttaatttcagtaacaacagatgctaccgggaatggaattggtttattaggagcaactactgtactcggatcggctgctggccaaaaaattgttgaacgagcatcagcaattttaatatttccatcttctgactgggaaatttctgcatcgtcattaactagagacagaataccgagaaaaccgttcaaatcgtaaattgctacatcaaaatcaataacgtcagaaatatttgcttccgcataagttgtaccattaactgcgcgagtcataataaattgaccggatttaagcataataccggagttaatagtagcgaaatttttaagcagagcagtagtatctttagacagtttcatgtaatttccttcaattcaaatgagatttaattttataactaatttaataaagcaattaacgattaaaatcagaagcaattgtttccgcaacaatttgagcagcaacaattagacgttcatctgcattaccacaataatcatcttctaaacgttcaccacatgttgtcataataaatttagcaccggcgtttagggattctgtagtatgtttgcgcattagttcaatccatttattacttacttcacgatcgatagcttcataatacgcatgtcgtgcaggtgcagatttaattttgttctgaataacttccattgcgttatcagaaagagacaaaacccatgctcgacgaattttattttggttttgcggatttgagtcagaacgcacgtgttttggctgaatatcttttacatcaacgttataattcacagtaattttagtcataatacacctttagtcataataatcagtaacagtccaagcttcatttctattggacattatttttgtatattctgctttaaatgcattcctaagcatagattcagtaactatatgctcttcattagaaaaattatttctcagaatatatcgttttatttcaggaatagttaatagatgctgtccagttgaatattccatgtttttcctccatagagattatactctaataaattaaagcataatctcttataaattaaaccattacagtaaatcgaccaactttcttcatttgaagatgctgaccgtattcttgcgggtcatggtctttatgcgaaattataaaaacattagtgtttttcattgaatttataatattagctacacctttaataccttcggcatcaaatgacccatcaaacacttcatcgagtattaatgtactaatactaacaccagatacaatagaagcaatatcacgccaagtaaataaaagagcaatatcaattcttgctttttcaccttcactaaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtgatatttttccattactaaattagtttttgtcttaacaattttatcaagttcttcttgaagcagtgctatttcatcagcatggtcaataaactcagaagatgctttttctatagctgctttaacttttttagctttatctaccgtcgtaattagagattgctttttattgcgaatatcatttgccaacgactgttgggttttaatattatctcggtattcatcaacaagaacttttaaattatcacgatgtgttgaaagctgttcaaacgaatgcgtgcattcagaaactttatctttaattttagaaacaactttatcaccggaactcaattgtgacaaacaggttggacataatccaccttcgtgatacatattaatgactttattatatgagtcaatttttgatttaattaaaactgcttcttgaccgattttattaaatgcatcagtcgggtcttcatctaaaacaatattaactaatctttcattagcttcttctatttccgattttagcgttctagcttcttttgccaaatcatcatacatattttgcagacgagtaagattgtcacccgttaattttttctggcgttcaacgttatcattatatattttaatttgttggataatactatcttttttaacgtcaagcacttggttttgtgaatttaattcacgtattagtgctttattaagcttatccatttcagctaatgttcctacctcaagcaggtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcaaaaacgttcggtttttgtcctcttttgatatagtactttttctcatcatattccatccacagttcaactaaaagttctttcttatttgtgctgtttattaattggcctttctttacatcacgaaatggcttgccaaaaagcccaaatgtgatggcttctaacatagtagacttaccaccgccatttcgtccagtaataagagttttttgaaccttatctaattgaatgtcaataggatttccacctactgacattatattttgatacctaactcggtttagtttaaaattcttcacaaaagattccttttaatgtatcttttagaccattctatcatatcatcataatctaaaaagtattcatcaaattcagccatgcaaacaacgccttgtgctgtttttgatgtaatataaattattccaacatatctagaatcttcttcggtgtaatcaatatttgctatgaattcatcattaatgtcaaatgtcgaaaacttcacagtatgcatccttaatacaagatacagccatatctcgtaatgatttaggtgtgtcattatctaaaatgttgaagttaaaagatacagcccagtcagtgcagactgtaacctttttaatacaattatcttcaacctctaacggttcaaaccaatattcaataatttctttatgcccaatatcatcttttacttcgcattcaaaatgctgactcatcataacatttttaaattcatcaaaagtcattgtgttgcctctacatataactgatttgcatattgaataagtgcttcacggtcagaatcagtgatgtctggaattgcattaatgtattcttccatcaacgtctgaagagattgaacttcaacttcttcactgtcatctgactcgacagagttatcaatctttgacacaactcgtaatgaatgcacaactttttctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcacctgcagttagtgtccatggtgtcccaatatatctgacgttagcagcctcagagatagtatggaagtgaccagaccacacctctttataagtcttaaggaaatcaggttcaagaccgtgagatttcattcctttataaaaataaaatccattcagttcccagtgaccaacacaaaaagaagcagatgaagttttgatatgctcaagaatttcaccagtattttcttcacacatccaaggaattaaatcaattaaacatccgtcaaaatctactgtagtaggcttatcatatactttaacattaggatatttagccaaaagctcagtagaggcatttggagttaaagtatttttaaagtgcatatcatggtttcctacaatagtatgtagggtaataccagcatcatcaagcatttgaactatttcacgggcgaactccatagttttgtgtgtgattgcttttcgcacatcaaaaatatcaccgtattgaatccaggtagtaattccatttttcttagaatattctattgcttgtttaattccatccaactgaatggattgaacccactcatcatcggctttaacgcctaaatgccaatcacctaaatttaaaattttcatatatcaagaaccgtcattgaaatgcaaaataaaattattgaaataaacccatctggcgtgctaaagaacccaatccaacatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcgcgttcacggtcataaagagttcggtcagatgacagttctttaatacgttcaaatgttgattccatgtcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaactgtttcaggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcgtattcttttgctaataaaaccggaattgaaaatgatttataatcatgcgcacaattacgagtaaatgatttatctttagcataaaccaaagttacttcatgaccatttttaataaaccaatcacgctgctcaagagaaaatttagttacaccgcaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcataactgccaccattttttgacttgataagaatcaacccacactttcatattggggtctgctcttacaataggaggattaacttctttaattgaactatcatggtattctttttcagaaattttcacacaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgtttcagaatatcccgacttttcttgatagcatattcgtattgagcaaaattattgttttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgttggacaaatgcattaaaacaagcttgagttatatacgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaagcagtatgcttggaacactttctccatcatctttttaaattcatgaatatctatgtaatgatcattaatatcagcgcgatataaaaagtctaaaaactttttatgggtattagaatatttacttccagttaattcagaaacatggctttcccaatatccaacaccagttttatttgggaaaaatgaaattttcatgtattggtcaacatagaaaatgccataattttcaatagtaatagaaatattaataaatttcattcattcatcaacttagccgcttcaagagctgcatctagtgaatcaaattgatcaacatattcaatcaattcgccgtaattggcatataaccaccattggctaaattcatactcaaggatgaatccgtttccttcaatttgagttaaaccaatgccatttgtatttacttcatacccagcaagacgtaaatcgttaataagagcttcgttcataattataccttagtaattttcaggtctgcaaattttttcttgcgttgatttttcatgcgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcaaagaaactactttatcatatgcgtaagaattgatggcgtttttaatttgaatagtcatacattatcctcaattacgttaaaattttattatccaaaaagggccgaagcccttagctaaactttttggcacccttccagccttcgtacatcattgcgactgacaatgacaaagctccttcacatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattaccattttcatcaataaatttaatccagtcatttactgaccacttagttgtatcaccttttggggtaacatttaaaatatatagcccttgcttaaaaagcattcgtttgatattcatattttcctcagctgtaacgatagcactcgtttgatttacgtttagcaactcgttgagaaatattataatcaaaatcatcgtcaatgtaaactgattttttcaactttcttacttcaccacgtaattgacgattcaattcattcttaacctctgaatcaacacctcgcatacgtcgccatttatctgagcgaaaaatgttttcaaccatatctttatgacttacaccatcaggagctttacgctttccgaaatagtcataatcacgcacttttaagtctttacgacgatacgttttacccatggagtttaatttccttagcaactgaactaaatgcagcacgatcgcaaatcatgcgtttatgtaacttgagtataatatagcaaacttcaaaactatttacatgagtaacacgaacagcattaccattaatgagataatactgtccctttttaatttctttatcaaccataaccatatcaattcctcaaaggcaattcatatgttaataataccacagtttgagctcgttgtaaacaactttgtgaaaattattttagggaatgataagaagggaacgatagcttagaatggtaatatacagaatgtgagaaagaaggacccagagggcccgtcttagtcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagcggacgatcatactcaatcttaccgttatttgtaagaactttatagaaagtaaaaggagcattgagctcctttagaagttttgtaactgattgacatccaggacaacgacctacttcttcggggatgccatagatttcaatcttattctttaagttcgagttttgttccacgagaaataattccttgataagcccagtatggcgggttaacagaatcctcaccagagttttcttcaggaaaataaacctggataacgaagccggattcatcaaaggtgaaataagtagtaggcagttcacctaacaaatcggcacgagcgttgatttcttcgaggtcttgttcacgtccagcccagaagcttgggttcagactacattcatagaaataatagtcattaccgaacatatcaaaaccattccaactctctactacataccgctcaaaactaatcataattaagcctttttatcaagaacagcattcagcttgttagtaattttatccagacgctcattgaactcgctagaagatagtcctttttctggagaaatcaaactaatcacgaaaaatatagcaataaaaggaataaggaaaatagctccaactgccataaacagaaagaatgttacagttgtaagaaaatcagctaaacctttacgaaatttatacatattttacccttaattaattaaccaagcattgataagcactaaactatattgggaataaaattctggaccaaaatgaaaaatcatatcatttatagtatccataatgtaattcaatttaatcatgtttccacaccccatcggtatttgaccaaagtcgctgattatctgatcctcgccacagctttttggtcggaagatttttctcatacttcccatcaataataacatcaacatatttaagcatttctagttgtttaatatcttcaaacttatatcctgtccacaaccaaatgcttttattgggataaagatttttaatagtttgaaccacagagtgaatcacgtctctgttatcaggataaagagggtctcctccagttatagttaatccttctatataatcattattcaaacattcaattaattgttctaatgtttcaccagtgaatggaataccatttctagcattccatgttgatttattataacacccttcacatttatgcaaacaacctgtaacgaaaagaacgaccctgcatccagggccattcacaaaatcgcaaggataaaatctatcataattcattgatgcttaaccctatgcatgatttctttatttttaccgagattaaatccgcgttcgttcgggtttccaagatatccgcatgttcttcttattgtgttcatctttttaggatcagtttctccacaaatagaacaaacaaatccgttttcagtaggagtcatttcatgggtacttccgcatgtaaaacacttatctactggcatgttaacaccaaaataatctaaatgttgtacagcataatcccatacggcctcaagaccttttaggttatttttcatatcaggaagttcaacataagaaatgtgaccacctgtcgcaatgaaatgatatggcgcttcacgagaaattttttcaaacggagtaatattttcttctactgaaacgtggaaactattagtgtaccagcctttatcggtaacatcttttacacttccatatttttctgtatcaagtttacagaagcgataacaaaggttttcagcaggagtcgaatataaactaaaagcaaatccagttctttcagtccactgtttaagatgagcattcattttagttaaaatttcttgtccaatatcacgaccgacaagaatattcaattcgtgaataccaatgtatcctagggacactgaacttctgccgtttttaaataactcaattatgtcatcatcaggtttaagacgaaccccgaatgcaccttcttggtaaagaataggagctacagttgctttaacaccctttaaagaactaattctacgcatcaaggcttcaaagcacagatccagtcgttcattaaatagctcaacaaatttctgttcattgaactgtgttccaatataagaatctaatgcgatacgaggaagattcagtgttacaacaccgagattattacgtccatcaagaatttcattaccagtcgaatctttccatacgctcaagaaactacggcagcccatcggagaaacaggaatagatgaaccagtgatagctttattgttcttagctgaaataatatcaggatacatccttttgcttgcacactctagagcaagctgcttaatatcatagttcggatcgtctttataaagattaacaccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggtgtttgcccgtttgaactaaagagagtatttacttcatattcataagcttgaaatgcatcgtatacgtctttttctgttttagattgagcataattcaacgcatcggcgatttgccatttttctgcatcctcaatatgttttgcataggtgcgtttaacataaggagaaagtactttatctacattcgcaaaagtcgttccgccgtattggtgagaagcaacctgtgcagtaatttgtgccataattgcagtagcaacaccgattgatttaggagtttcaatctgtgcattaccaagcttaaatccgttctcaagcattccttttaaatctactaaacagcaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaactgtgttttggtgtcagattcattatattcaaatcctctttgaagcatctcggccatcatttcctcttttcctaaacgagaaaattcctttgatttatctccaacaaagttagggtgaatattattttgggtgtaatcggattttaaataagtaagtaaattttctaaccattcaagataatcaacaccttgtccctttaagccagaacgattaaatttatgcttcatttgaccttctgcggcattgcagagattacaaagcaatccacgtatctttcctgcttttggtccatttaattcatggtcatgatcaagatgattagcttgaacatcaggatttagttctcgttggcaaattaaacatttaccgttttgtgcatcataaaatttctgtttttcttctttatataatttgccagtcaataacataataaacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgccttgtcagaaaaagaattttgagttttttcaagtattataaaacatttgatgcaatcgcttatattgccgaatcatttggtcagaaaaagaattttgagtttcaagccattcaatatattctgccgcagcttgcatcaggttaccttcataatcatcaatatcttttttcaatgccactttagctaatgcatatgaaatacgttcaccttgaaaagcggctttaggcttctgaacatcttggctagttctctctacaacttcctcgatttcaccattttcaacggattcagtattccacaaacaccaatacgtaattggcttatcatagatgttaataatttttccatcagaaagttcaatttcaataattccagtgtcaggctctatatcatcttcacattcttttgcaagttcacgaactttaaagacagtacctgcactaagttccggccagtaattacacagccctgtatcagcacgattaattctaaaccacttatctactgtaatcatgtcccatctccatatcaattaagtcatttatcgttggttcattatatactgtttcttcatcagtgtaaaccggttcttccggctctggctctacagtttcccatctagccgcccaccaaggtttaaccccgaagcttattaagttcttcataatcaacccaggattctaatcctgatggcaggtcacattcaatttcccaaagaagttcttcaattttatgaagacgatctaattcttcaacaggaatagtaaccattgatggagctcttgctgcactaatatcgtatatcatatttaccccagtttgaccatgcaatcaccgtatttccacttagaaatagacttttcaccattagaataataaacttcgagtttagcacgattatttttaatttgaataaccttggctgtcattaaagttccatacccatagtaaactgcaacttcatcacctacatataccgcgcttccgcggtaatcatggatataatcagttccttcgagcatcatttaaagtattcccgcaattggtcaaatccaccaatatgacttccatcaggagcaaatacctgaggcattgttaagccgatttgagtatcacgacctagtttagtcagaagctcagcgattttctcatcatcaaaaacacctttttccggcataatgttgataaattcaaacggctgtttcttcacggtcaaaagacgttttgcattatcgcaatacacgcatttgtggatgttgctatcataaccatatactttaaacatattattccttaattcctaatacttgtttaaaagtctcgtcgtaatcaagactttggcctgtttgttctttatgtttgtatataatatcacttacttctgatagcatatttttatatgaacgagttaaagcagatttaagcacgctgtatctatcaggaaatttaccgtgttcattataataagctattgctaattcacggactgccttttcagcagcctccatatattctttacgctttgtcattttcttctcggtcaaatcggtgtttacaatggcgacatttataacgaagattactagtctgccaatggaccaattgcacctgtttagttccacattcagggcaattaggaacgtttttagaagcacgttcgcggcgttcaaccatgaccattacagaatcccaattaatagggctgctataatcatcacaaccatgaatctttccacgcatttccaaatcgtcttcttcaccggccataataattttaattaaactggaattacttgaagctgcaatgtcttctaatagacgctttttcatttcaatacctcaatagcattacgtaaaccatttgcttttgcattaagagcttttaacaatttggtgtgttctgcaatttgggcttcaacttcaatcaaacgagcattgagatattcgcgttcttcactcagattatcaatcttttctactttaggctcttttacaactgtcttatatgtattagggttcttcagtttaattagaatgcgtgaactgtataacattgaaccattatcttcggtttcgtcatacatttctactacgtccatgatttttaacatcatgcggagtttataagacaacgaacgaatagttttgttgtgcttattaatttctctagagttcatggtgccgagattacgtgagtaataataaggaacctggatattaattagcactgatgaaccacctggcttatgtgttacttcatcagcaataacccaatccttaacatgaactgtatttgtacggtcatcgcccgcggtaaatagtttacgagcatgcttaaaaagcatattcacttggtcattgaattgacaagcgaatttatcagcaaatttagtttcgggaatggtagataaccaatcagccaaatgggtctttttaacatcgttaacaatagtaaattcaaccaaatcggttatagatgtcgcagttttaatgaatctcggcttcataaagtttttaatgttatcgcgagctacagtagaagataacatacgagaacgtttaaaccattcaagtaaattgcctaacgaatgagaataagcgttctgagtatctttacagatatgattttcctggccaacatactgaaggaaatcacgaagaatattattgattactgctctgtgtccgatctgataattacggtgtttagtaataaggctgtcaaaataatcaatataatgtttacgagttttcatgttcttctcacttggttaatgatttatactccgagccatccttggctttaaattacttaattaactgtaaagcttgttcaagacgatccaggcgattaacagattcttcccaaatccttttagcctgctcatattctttctgtgctttattagaaatttctagaacttctttataagctttttccagtgcaataacttctggacgaatttctaccggttcaggtgaatcgtcaagacattccattagttcctcaagggtagtttcttctttaggagtattcacaatttcatcacatttttgctggtaaatttctttatcagtcggtgagcacgcacactttacttcacgaaggctaattataattttatatccttcccaaccacacatatttttgaaaggatatgtatgaatactttttacagtttccatacagcccaaaaccgcctctaattgataagttatagtgctagcaattgagaaaaatttattaatattcttttggttagcgtttggtgtaaaaaatccataattcacaaaaatagctactttatttttatcaagctcatattcttttacgataatcatatcagaagccaaaggatgaatttgacgataatcgccataacataatttagaagctgattttagaatttgtcctttgaaaagtctgaaattactaatccaacgacgagtaaaaatattctcagggtcttctttattattaagatgataagaattaacatcaccgaaccaattatatcctactacatctttagttcgtttaatttctttcccaaatttactaagaatatctctgttgactaagtatgaaagaagacgagaccctttaaaggttttcttaatgtcatctttatctgtacgactagaaatttcacgaacttcatgaataaatttgctggaagaaacaatacttgcatcagtattattgagccattgattgataatggaaataacactattctgactaaacacaggtttaactttatcatcaataacgctattgaatgatttgatatattcgttacgagtcatattaatctcctcagtagaaagtaagaacattataccacatccttgtggcaaagtaaactagtttagtgcatttagtgcattgttcagtttagaacgttgcttcgtaagatttttgactttttcttgtgctttttctagcatcttttcagcttctagcacttcattggtcgctttaacgagttcatcatctactgtcttaagagacttctcaatcgcatccgcgtgccatttttcaacaggtttaagactcggattttcaacaggaagaaaattcactttattgaatttccatgcatctttattacctgagctatacatccaaaatttaggatcgtttgatgagcaattagataaatttaagttatcttgcacttcctgctttttctcttgcgggacttcgtcctttctcaaaaaatcgtatttaaatgaaacgatcatatcaagttcatacgttgttgtatgttcccaatttcgctcaaaatgaggtaaaatcttagattgaacagcggcaacaacatccatatacttaaatgcttctgtcaactgtgatttaaggcattcacaaattgaaagagaattttttgtattaggtttaaagctaattcgtgcagttctgttattttcttttaatggtcttacttccatctgaagagtataaccatcaaatttcaggttctttaagttaatatcagaaccttttaatcgactagccgtcgacaaaatttgctttaattgtttacggaatagagcaataaatctccattcaatacgataatgatttggattaaaaaatccagatgataaattaaccttactctgaccaacgccttgaacaaatagaggatttttataatcaatagttttacagaaatcggtgagctgctcacgagcagtcatttgtgtaatataccccgctttactaaaatgacgtaaccattcactgctattcatatatttaaagtgaatatcacgattaactttatcagggtctaaattattttggcacaaaaatgtcataacatcacgagtatagctggcattacgaaccatatcttcaatttgagaacgagttttcatagtgttccttaagatttaagtaaatcaacaattttaattaacttttcacgctcagatttagctttactactcagtccagatagtctgaaaatttcatcatcatattgctgaatagaaatattcagctcttcaatctgcttattaaaataatcaatttgttcagaatgtttttcgttactacgaactggtacaggttttgtaggtaatttagatgaactggattcatcctggcgataaattaaaatacaacttgaaccaattggacattttgcaccagatgaatattctaatgttccagcttcttttaaaacttcaaaagctaaacagagatgatgccccatattgacataatctgtagagcgagctctgacgtaataatcatctccgcgaatactaaatttaaagcatttaaggtcttctgtattattggtcttaaaaatcatttgtttatctagacccttagctaatcgagcgcctaatgctaataatcgtcgttgattttcccacaaatcctcaatcatttgatcgaatgataattttggcattagtcgaccataaaggtcatatcctttattataattacgaaggatttcactcgcgttaatacgagacaacgctccaattttattaagggctttcataatgcgattagataaacccattccagacccgtttgttcgttgtaaatgtttttctaatccaaacccaatatcaactttaaatttatctaaaatttcagcatgaacgtctctgtcaataacattcaaatccaaagttgggttaaatctatgaaaaaatttatctggctctccacgacgaagtacagtccattcattcaattttttattaactaaagatttaattactgcattgacattattaattactactgacatattttcctcactcaattttcaattttactaaatacacagaatatgatggaacagactatataagcaccacacacagattgaactaataccattccaaagaaccaaacaatattatcaaacaatgtctgttttacgtcgaaaggacgtaaacttacagtaatattatcgcctttttctattgatgaatacatctctggtgaaatatattcgctaaatctataaccgtctttgagttcatatacggcaataaacgataaactagacccctttccttgagttcctgtaagggtattaactacagtaacatcataatctttataatgcatataatcattaatagcataataaccatatgcaactactacacataaacagcatatcaataaattcaatcttttaattatcaactgtttcataataatctcaattaaaagggcttagaaccattataccatccttggtataaagcggttatgcgagtaccgtctttaaccgttcttcaaacttccgaagagtattttggcgttcagctctttgctttttgtaagtttcaatacgctctgaaatgagagtgtatcgttcatttactgattctttcataaaatcaggaatttcacgagaagctttaatctcgtcaaatttatcaataactgcttgctcttcagcaattaagttatcatacatcaaaatatctttcttgatgaactcaatatcttcttgagttacacgagataatttagatgctttatcctttttgtactgttcgttagtatcacgagaccagtgtaatgtacgatttttattcgtattcttgtaaatttctacaataccaatctcatcaataataacgatccaattccaacgggatttgtaaatttgtcctccatcaaccgtgatttcaccaccgattgagacatcattaaagaacttgctttgagcttcagatttaaatttaccatcattgcagtttaccaagttgaaaatatctttagcattcattttctgttcctccgtagttgatagttgtataataccacagaggaacagtcttgtaaacaactaaaagaaacttctttcacaattttttccactgaaccaagcgctcactgctttcttagtctcaggagcagtgttatccataaaccattcaaaggcagcctttttatgattctggagggcttctcgggctttaatctgctcacggtctattaacactaacatatgagcctttcttgtcactaagggcttcttatgattttttgaatactcccaatcatttgtccaacgcattgtcgttgcgaattgaagtacagcttctttaatcttagtttcgtaaatttcacgagcctttgagtataacatcactacctccatttaccagtttaattctagtcatctttttaatgacagtccatataatctatttctgaactgcctttttgtcttagaaggcctcttatgaatttatttcagaagagtaacctcagcgatttcttgccaaccgtttttgtcggtcataataaagtcagcaagataaagagcagtacgcagtgaaacattgcgtaaacgattaacattgactttcatccatgataatgctttataagtttcttcatcagaaagaccgcgcttttgcatcatgtcagttgaaagaataacatcttcaaccctgaccataatttcttcattagtgtgaacacccaaatccaaataaactgagcgggacactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagatgcagtgctccagcagactttacgggtctctccagtgtccagagcagctttcagaagattaagaatgtccatatcagagaaaacatccacatcatcaatcaaaaggacagaattctcttcacgattattccaaagctgttcataaagaccaataccagagattttaccattaatgcttttatattcaatgtatccaatatcatttgctttatttaaagctttatctaaagaatacgttttaccaatgcctgccgcgccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcgcctaagagctcaaaagttccagagatttctttaccgaagtagatacccttattgatagttacagttttcattttattctccaaatccgtatcagttgatagttgtatagtaccataaagctttatgcttgtaaacagttttgtgaaaaaatttttaaaataaaaaagggagcccgaaggctccctatcatttataataacttcgatggttttcaagatagaccttctcaaggaagtcatcccagaaactcatgtctactttttgctgcataccgttcttagaagcttcagtagatgctgcttctacttgatcgaccacatcttccaaaaactcttgaacagttttaaatggatgtttacccagcttcacgtcgagaataaatggagcgtcttgaagtggataaactaagtcaccagttttgtaaatttccaatagttggagtccaccacggcaagcatgacttagagctttccagtcaatgccctcattcgcttcagccttacgagcacgttcaccgtattcagcatctaatttgttcagtgactgcttaagctcaataagagaaagcgttgtctgatatttacgacccaacacagtgtagaacgtttgtgggcctgttttctcatgattatggaacacccattcacagaattcgttttctggaagacgatgcttaatatcttcaactttagtacgacgctgcttaatggaaccgtcttcttggtaatcaacccattgctcagggatttgattaactactttcaatacatcacgtaatgcagccaaacgagaacccttaacgccgtatttagaagcttgcttacggacatatcctaaataggatttcatgttagtcgtataaaaacgagaacggttgtcttgaataaacttccacacatcaggcaaatcagatttaaccactaactcaggtggagtgtgaagcatatctaacgctacagtttcaccatctgctgctaatttaaagaaatatttaagactgtatagttcatggtcaatatcatctttagtgtttttagatgatgtgttgttagtgtttttgctcatatgctctttaacatttccgataagaatatcgcgagcaggaggaacaaagatttctttaaaatctacatcagattctggggtagaggttccataaagatgactaccaaaatagcttttcattactgttttcatcattcagccttatattcaataacaggacatactttagctttacgagcttttaaaaattcaacgataaccgatttctttggttgaataggaggtaaacctttatacgccctatcaatattttctacgtgtaaagcataatcctttttccatttataatctttatatttttcacgcaaatgtgcaggaataacaaatgaaccgataataagtaaaacaaccaaaagtgcaagtataaatgccgatggaagaagagtccataaactaccaaaaataagccatttctgtatgatttctgcacagataatagttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattatcctttcattgaaggtgtaacagttgttaaatacttaatcatagcttcagcttctgattttgataatgaaatttcttcattgttttgacgaatagaaataaaatccggatgacggtcaccaccagcttttaaaacacacatataagtatcagtttcatcttcaatatctgaaatgattgaagcagttccacatgaatgtggtttttgataaatcaatacagcttttcttccaccgtttgactgttcataaacttttaacacatcaaacaaatcgcttcttttatcaatagctaagatgttgttttcatcttcaatattaaatccttcggatacttcataaagtgtcacccataaatcaccaatatcaataacagcgttcacttttccatgactttcaagagcattacaaattttcttaatttcatcataactcattttaataatatcatctccttgaataaggaagatgtcatttttaaattcaacacgaattaaaccacttccacttgaaataaacatatttcctcactttgaaatcatagttggaatgacagaatcgagataagtctttagcgcaatagcttcgtctttggtaaatgtgacaatatacgatcgaaaatcatcaatttgacgaatagttaagacatcaccatcttcatagcattttgatacgtttaaaacagtttcatcattctgattgcaagcgttagtaataatagcattgcaatttttgagccattttaaactatgttttctttcattagaataataaaaatatttaatcttatatcccaatggataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgtgtcaaacgatacatattatttactttttctatagctaattcaccaaaaagcggactaacttctaatactaatcgtttcatattgattctcttcgactcactcacaattacatactcctttgaataatatcaataatgttgttcaccagattataagtaaacattgggtaattatattgaatcattacatacacaacaaacaaaactttcattctcttctccttgacagttgacaagattactataccataaccttgccaacttgtaaaccgttaaatgttgttttcaataaaattctgaagctttgtgtgagcatcaaccatgattttcatttcttctttggcgaaagctgtacctctttcccgagaagaacactcatagtcagaaactgcattagcatattcttcaattagtttcattaaaaacatctgcttttcagttttcattgttccacctaatcatttcaagatattgaactaacttagctttagatttatccaaatcctttttagctgcttctataccatcgtatgaatatccttcacaatgctcaactgctaattgatatgaatctatttcaatatcacgtgctaatttaatgattttttcaaactgttcgcgtgttagcatacttacactctcgtattatgatcgataatttcatcaagaaacatatctaacgcttctatagcattatccactttagtttcaaagtctttaatgcctttattcgaaatacccgatgaataccaagcaaagtcaatcagctcttcatctgctttgcgaattgaagccactaattccttaattttatctgcttgttcaatgctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattgagtgcttcaattttcatgatgttctcctctttatccgatggttgtatagtatcacagctcaaattgaaagtaaactggtaaaatgaaaaaagtctcccgaaggagactaatgttattcgagggaaagaagatatttgctctggtaaaacatcccagtaatatcatctatcgtgctttgaatggctggaggcatttctttataaatgctgttagattggtctagtatgcgatcaatcattttaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttgttttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcattccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcgcgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcatattcacataagctattaattcgttttctttcttatcaaaccgatcagcaaattcttcttgctgttcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatactgtaactcaaaactattcatttcggtttaccttctttaacgaaatctggataaggataaaatcccgaataaaatccttcacctttatgattgatgcatcctttattagaacaatagcaccaataatcgaaatcacaagccatttcatcgttgcataaagcaaaaacaactggccatttacacttttcacaatgggcatttttaagaatactagtttggctcataaccatgtaacctttaagcagtattcttctacatgctgtttacgacctttcttatcaataaaggtatattcaacgaatgttccaatgtagtctttatctacatcatgcggactattaattggacatttagtacggcaaatgcgttcccattgacgaataattactgccttattctttgggtcatatggatgtggataatgtatattcataataacggttcccaatcaacaatcacaatttctaatttagaggaatatgtatctaaaatcccctcaataatatcccagttccctttacctatgcctgcaccaatcctaggcatatagattgtaggtttaatcagtttattttcaccaaactcatttaattctaacatacaattcattaaagcggaatactcaaaatttggccctggttgaaattgagtataaaggttgaagcaatacgctttatgagtcctaaagtatttttcatagactgagtaagaaccgagtttagttacatcaccccattcagtctgtaatttatcagcttccaaaattttagggaaagctttggttaattgacccgctacgcctgaacccatagtatgaaaacaattgcatccatgcgcaatatttttaccttcagcgaaaagggcgacaatatcgcccttgatatattttacaatcatctagtactcaatcctcgattataagaatctactaaacggtcaaccattgaatgacaagcggctttatctttctcctccgcaactgaacattctaaggtattccactttttagcatatcgttttaacaatgtatcatttttgtatctgcttgatttatctctttctccgtctttatatgcatatattaatttctgtgcaaattcagcttggcatgctttatttttcccgcaataatccgctgcagtacggtttacatactctctaatttcagtatatgatgtatctgctaacgcagaaaatgaaattaatcctatacataaaaccaaaattttagtcatttactatttccaaaagtttattatttttaaggtaattagccttttctaggacttcagaagcatatttagaacctgctttaacattccatcccgaattataagatgatattgcttttcttatatcacccttatgtatatttaaccaataagaaagttcaatgtacgcccaggaagctgaattggaccgtttattcaacattctttttatttcagcatcggtcatattataaccaagttccttgactctcgctcgcatagtaggcaaataattttggaacattccataggcatgatgctttggtttagattttaaattaactccgccagagctttcttgccataaaatagcagccattatatgacctaatccgctcttgtggatatttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactattgataattgccatcctgcattgaagcgacgggtctttgaacttcgcattaggtttacaaactgtaaatccaagccaaagatttccatctgtgatttctaaacgtccaggacggtattcaaccccatcaataaaatcctcatcaatgtcaggacgcggaggcatactcaggaattcattaacttctaaaacatggtcttttattttgtggaataattcaaaaacatatgtctcatcaatctcccgttgaattgcacgatcaagaagatgctgagaatattttagatgaaacgatgagacccctgctgcttttgatgcctcacgaatctcattgttaatttgacgaaactccgactcaaagtgacgacgaagcttatttcgacggataaaaacttctgtattgatagtcatgttgttctcctcttaactgatagaaaaattataccacagtcaagaggaaaagtaaacagttattctttaaatctaatcaatttattcatagactttgaaacttctgcacgaacctcatgtagatttttgagctgttcaagacgctgctcatagtaagcaatttcatcttcttcgagacagtcctgtgaatcttctttaagataccgtgcatagtcctggaaagcgttacggactacttcctggaagtcatcaagactttgaattttcttaggagcagcagacacacgacgaggggcagtataatactcataaccaaaccctgcgcttaattgagccattaatatttttcctctggttggaacacagcacgacaagcccacatactggcttctttgagtttcattttagcaatagctaactgatcgaggctttcagcataattcttcgcgagttcaaagtcttcgcaattatctagtgcttcccagaattcatcatataaagcatcaaagataagtcctaaacgaacttcagcgtctttaatagcatttactttaccgattttttcgtcggtatgtggcttataacctttaatatcttcaatcatatttgacttcctcaccagtacataaatcgtattcaactaaacgaataggttcatgaatgccatatccctgaacagaaatttctgtcgtaggataaattccactaatatcacccatattccacgcttcattaaattgctgttcgcctgaattactaaaccattctgcgaaagcatttaacacatctttagaaccttcaataattatctttgccattacaagctctcagtaaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattagaaaataattttatccaagattgttctttaattaaaaatggctcagaatcatatgccattaaactttgagtaattaatcctttaaatggtccatcaataaattccatggtaaaatatggaattttattcattaatcttgcattaggagcagtgcacaaaactctgcatcctttgaatacacctttttgtaatttgtattgcttgggataaaattcgctcaagacgttgttatttgccaaaatttcaaaatgattcaccaatttatttttaatagtttttggcgaaaaataaagatattcgaaaagttgcgtatctgtcatcattgcattccaattacgaaaaactgcggacgagtaataccgccaatgcagcatttactattgcagcagtgttgcacagtttcaatatgaatatcgtaaatcttatccatatcagaagatttgacaggctcatcaattatatacaaaattcgcgaaagcgataaacctctgaacttgcttcctttattaccaataaaactgcgtacagaatcagtaaataaacgaaaacgtatatcatcattagaataacttgaaaattcctttttaatgttatttgcagaaattttagcgtaagctgaagtattagaaagaacaataactgttccgccatcatacaaccaattagcagcaaagttagtcacagcaattgatttaccagattgacgtccaccgtctagtcgaagtgtgcaatactgtttaagcaagtcttcaaatggcaggatatattcgtttttacaaatttcttctactctagcatcagaatggtgtgtaaaagcattcatcagggatagataaggaccagttaaaaatgttctcattttattctctctaaatttgggccattccatggcgcatgaattgtccatttctgtatttacccattaccgcacttgggctcgaccttattacaggttggtgggaatccctcacagaatcatgaggtccaggttattcccatgttatttaaatgtaaatatttttgccgtaatacttataccagtgtggcttcattaaaattttttcatcgagtcgttgttgactcaacttaatagctgatttacatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaggtgtttgattataccatctacttttagctaagttaactgctgcttcatcccagcgtttttgttgaagcatacgcaaagagttagtgaatccagctacgccagtttctcccatttggaaaaccatattaattaatgcacagcgacgaacagcatcaagagaatcataaactggttttaatttagcatttctcaaaattccacgaacagcagcatcaacatcctgattaaagagtttttcagcctcatcttttgtaattacaccattacaattacgcccaatagctttatctaattcagatttagcaacacttagtgatggacttttagtaagcaaatgaccaatgccaatagtgtaataaccttctgtgtctttatagattttaagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacaccatctttattttcaaaataagactcgcaatggcaatttctgaacatctcatgctctactggaatcgtataataaaataactgtaagtctttattactagaatatttaaatatacctaggtcttctagaaggtctggattataattgctaaaaccggtctcttctaagcattctctttttgcagcttccagtgcattcaaatcagaactttctacacgcccctttggaatatcccagcgatgtgcaatcattccaggtttacgagaaccggtaactcgtcccataaataaatctttatcttctgtcataaagataataccagctgataatgttttcattttaatttcctgcattcagtgataaaattatttaatttttgagcatatttcttttcatcaaaaatcttttgttgtctgcgtaaacgccatggcatttcaatgaacatacgccatattcctgataatactgctgctgtaaaaatattaacaagtatagttaaaagaacccaatctcctattctgtccattggattttttataaaaaagtaaaatacgaacgatgatataggaagactaatgatataccacagaagaaccttcttatctgtgaaccaatcagcattcgttaacttagcgcgaccgttttgaatacatacgaacttatcatctgttacagtaaatggcttagctgcttgatatcccattctaaactccctaattaatcgtttctttgtatcttcagaacagccgctccagtcaactctatcaactgaaatgccatcgtccccatcatctaaatcataccagcgagtttttaaaatcatttaattttcctacaatcactcacaaactcttccattgattctttttcaatataagacatatagctattatattcctttaattgtattttgtaatccttttttctttgccaatttattttaaaattatcataatgaaaatataacatggtaccaaagaatgaaaataatgaaatcgctatagtataacaaagctcactccaaacttctgttatatttactgtgccgtcgatgtttaaaataagacagtcaatcattaatccaataagactacctgcaagagctgcaaatgctgatatggcaagaattaatagtgcctctggaaacgaatatttgactttatttagttttggcttttgcatcgtgattccttaacaaatttcataatttcatcaaattcatacgcagcaagtttaagctgatgttcctttttaatctttttgcactgagctttccattcgcgtacgcgtttacgataatgtcttccttgataccagtatcctacccaatttacaggtattaataaaagcggaactaccaatggaagaattagtgttgctccaaatattacaccagattcaatatcagtcataacgtctataaccattccagcaatcagcagaatcacaaatgatacagctaccacaggacctattaacacatcagtagaaattatctgacgctttggttcatacttcaacggtttacttggaaggtatagtgatggttttgacatattctctacattccttaacaaatttttctaataataaatcgctttcaaaattgggattttctacgaatttatcaaaaagatcatcaacaatagttaagatattctttttactaagaatacgtttattttcatgcttcgtttcagaatcaactataagagtaaagaaatatttcttgccctgaaattttacagcagtatcaatatagaataaatttgacttttgtaaattacgtttaaaccatgcgtcacttaaactataaacaccgagataatcaaaatcgtcgtttaaataacaaaccgtccattcaggagaaatgaaatcagtaaattcaacatcaaaatcacacgtcaatgaatgaattgattcaatactgttaataagtattccaggacgtattaaagactttttacctctagaaaatcttccagaaagactttcatcagtttcatatgaagaaccccaatagtaattacgtccttctgccatgcgtttaagagcatttagtaattggtctggaacatcaacctgtctttggaactcttcaaacattgaattgaaatcactttgcattttcattttcattcctatttactccaagtataaggggccgaagccccttatcattatttcagagaattaatgtattcctgaacatcggcagaggtagtttcaaccccagaaatattaccgttaaaggtttcaactcgagcaagggtatcttcaatatcaaccttagtcagtgctgcaatttcaactacatcatcagcagtactaattccaagggcatttgctgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagcagttttgctgccgcagcagtatactgctcttcaacagataaatttttagccatagcagaaccaagtttagtgcgaataaactcaacaattttcttcagtgtgttcatagtatttccttaggttgattagaaattaaaatctgcagaagaattatatcatgctacttaagagatgtaaactatttttaattttacaaattcgttcagcttcttcaacagcggcagtgataatgcttttagctataggagtactaatactagtagcttttacacttaacacgatttctttatctttaccgggccaaccccacgatttttcaccatgagtgcctttaattacagcagacacctcaagtgagcatccattatcacatgtttttacattaacaacccaagtgtcacttttctcaaccggtttatcccagtaaatattaagaatacgtgggacatcaaatttagcagggcaaatcttaaccgtaagaccttcgctttctagccaattaataagagggcgttcatacatgcggcgatgtgggctttgaactcgacaagctttgtacccattgcttgcggcttcactaagctcttctaatacctgcttttgcattattgataagataccatcaaaagatttttcggaagtttcattcagttcggtataaagagacataacagttttcctcaaattataggctcataatatctcaatcatgagcctatgtaaacttatttcatattattgaaatattcttctgcgatttcgtcgttatcatggtaaactttagaagacagtttaatataaccttcagcagtgaacatgttaatcacaacctttacagtataccactgaccgtcttcattacccattactgcgtaagtttcaaacatcggatgatcaggaccgataactttaatatcattcactgtacgaccaaaatcttctgaaacacatttcataaagaagttgaacagttcaccgtaattatccatttcattctccaagttgttttctgtatcagtagttgatagttgtatagtaccatagaagaacagggatgtaaacagttttgtgaaaaaatttttaaaaagttttggggaattctagggcagggaggggaaatcaaaggataggataatatattataaagggtagaaactaaatgatgtctagagaggcctggaaaggcctagataccaaaaagccccaacctttcggctagggctaagaatgttatttgatttgtttagcagaccaaatgcggtctttaataattttttggatgtcttcaacatactctaggtcatgagcatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttacccgaagcctttgcaaaagcagcgccagtagcaactaaacttttccaggccatactaactgcatttccagtaaatccttccgctttcatgtcgcgtgcgaactggaatcgcgattcatcagaagcatctttgtaagaatatttacccgctgcaatggctgcttttgcgacagcttgaatttcggtgctagatgcttcatttaacaccgcttcatttaaaaattgagtatatgatttcatcttatttcctgttttaattcgtggatttaatatactactatatttataccaaaaagccccaacctttcggtcggggctaagccttgcggcaaccttgtcggggttccacctgctaaggcaagtgtttgtacgaaacgccgggattcgaacccggttattaagtagttgacgctactcaatattttaaaaggccatatctcgaccatatccgaacgttccgtcaaaaacgctactcggcttacggcaaagatatttcctcgaatcgataattcggtgcgccgtttctgctgtgatataaggaggcattaacaaaacataaagatttattaatgccagtccttaaacagggaacatcagtccgacgacttgccggtagcgacccggcttcttgtctggtcgaggcagaaggattctaaccttcaacctacggattagaagtccgttgctctatacaattgagctatgccccgtaattaaaatttcatttttcgacctttaaaccatccttctggaattgggtcagttttcttaatacgtttagaaactttttcatctaatgaatgaatccacatcataccaaattgggaattcttttcacctttctggtgattatttttagcgtgaatttctttcattttattaatagtttcaagagtatgatgcttatttaaaaatctgctgttatttaaaaatttttccttgtattcaggagttgaccataaacgtttaaatacatttgaaccattttgacgatatttttcttgaagtaaaatatcatttttaaaacgtgacttaaacgatttagctccttttaaactagcgtctttcttctgatttagcatctcaggaatatttatatgatcccatccgccttcaccgccaagttttaaattatacacatctggtctatttaaaaactcttctgtgacaatatttttctcggcttcaagcatagattctttatcatcaaaatattctaatatttctttagaaaaattttctataccatacctgtcttgggctctttttaataatttaccagaacccatatatccatcatctaaattttcggtagaatgcacaccaatataaattttattattaattttatttgttattttataaagataaaaatgcatatcagtccttaataaagaactgagcgtctcacgacgagtcataaattggtggggagtggtggagtcgaaccacccgagtcgcaatgacaatgaatttacagtccacaccgctacctctacgggataactcccctaattaatttggtgacccagaccagatttgaactggtaacctttcccttatgaggggactgctgctaaccattgagctacagggccttggtgctgattgacggaatcgaaccgccgacatcctcattacaagtgaggtgctctacctactgagctaaatcagcaacggaggcgataggatttgaacctatgagtcgccggagcgactgccggttttcaagaccggtgcattaaaccactctgccacgcctccagtctccgtggcaggatttgaacctacgacattctgctcccaaagcagacgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttgaccattctcgcgctgggaataaaggactcgaacctttgcatcctggaatcaaaatccagtgccttaccaacttggctaattcccaattattaacaaaggctctctaacaagaacccttgatgatagagggtattaatcagtgcggtatgaattaataataacaaataattcttaaagcatatttaccatttataataatacatatttacgatgcattcaagacccaaaggattcttgaaaatatcatattcaagaggacctttttctgtttcaataaagaaatcaaaatttactgtattaaatttacgttcttccttcactaatttaacttgagaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaaaacattttctgccgtagtcaataatccgcatataaatccaacaaacattgaaaaactgaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgttgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttcgtttggtctcctttaaaagatgaaggatctactgcagcagcaagttctttaatacgagagaaaagacgctcagcttcagctaaagccattccaagctttacttccataccgtgggaagattcagtgatagtagtttttgtagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactcttgaataacatatagtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgtccttcgtcatcaaaaacaaacacacctttaattgggcttttaccattaagatagcaaaatgcttgttccataatcgtgattacttctaatttagttagatttaaattagtctcacgatcatagtcaattccttcaaactctttacgagttaagcaaggatagtcggtatttgctgcaaatactccccatgcataagccaatgcatccttaataggaccagcaagttggtatttaactgcagaataattgctcatgataaaatcagcagtagtatcttttccactacgctttacaccgcttaaaaagattagtttcatatgtttctcctcaaatttagttaagattataacacatgaaactgaagcattaaacttccgctataatttttccatctttttctacttgaaaatacgtataaggaatcgttgctgtacatactaaagccgggtctgaatcttctgtgtagctaaattctacttcagacaggtcagaaacccaaggcttataaaaatttattgacatcacgatttcagttttactattatctaaaatgtaaagcgtaatgtattcaggacctgttttttgggcagtattttcacctgtaagatagttgctagttcctagcatccattcatacattcctatccatgacttaagttcttcatcaactataaatctcacgatgagtggatcgtactcaaatgtagcacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataactgttggtggtataatgggtctaagtcccttccattcaattccatttagaacaaacaatagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccaggtatatatgccttaatcatttggtctgcacccctaaatcctttcacttgactccaatcaatttttaatttcgttttattagtaatagtaggtgtatttgcatattgctttaaaagctcttctagaaactgttgacgagctttaggtggaatatagtgcaagttcaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcgcgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgattcctctttcttcagcaaattgctttccggtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgttaaaattctaaattttattccacgcttttcagctaaagcttgagctgctttccatttgtcagtattaacggaatatgtataaatttcattcataaatcttttcttcgctgcagttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgtcgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctggaggttctggcagtaattctaggtcatcctctgatactactgaaccgacggatcctcctgctccagtaagaaaaactctagttaaaaattacacaaaaactatagttggaaattggagtcgttgggctaataaattaagaagctatgtgtatgagaggtcatagatgtcaggattaagttatgataagtgtgttactgctggccatgaagcatggcctccaacagttgtgaatgccacacaaagtaaagtattcactggaggaattgctgttctcgtagcaggtgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacgtttgctgaaataaaacaaaacctcattgaatggcttaatggccaaaatgaatttttggattatgattttgaaggctcaagattaaacgttctgtgtgaccttttggcttataatacattgtacattcagcagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattacaattcctcgcggaactcgctttttagcatatgcaaaagatacttctgttaatccatataactttgtatctaccgaagatgttattgctattcgtgataaaaataaccaatattttccacgattaaaattggcccaaggacgtatagtaagaactgaaatcatttatgataaattgacacctattatcatttatgataaaaatattgatagaaaccaggttaaattatacgttgatggagcggaatggattaactggacaagaaagtcaatggttcatgctggttctacatcaacaatttactacatgcgtgaaactattgatggaaacactgaattctattttggtgaaggtgaaatttctgttaatgcttctgaaggagctttgaccgctaattatatcggaggtcttaaacctactcagaactctacgattgttattgagtacatcagtactaatggtgctgacgcgaacggagcagtcggattttcatacgcagatacattaacaaatataactatcatcaatattaatgaaaatccaaacggtgacccagattttgttggggcagatggaggcggtgatccagaagatattgagcgtattcgcgaattgggtactattaaacgcgaaacccagcaacgatgcgtaactgcgactgactacgatacattcgtttcagagagatttggttctattattcaggcagttcagactttcactgattctactaaacctgggtatgcatttattgctgctaaacctaaatcaggtctgtatttaactactgtacagcgtgaagatattaaaaattatctcaaagactataatttagctcctattacgccatcaattatttctcctaattacctttttattaagactaatttaaaagtcacatatgctttaaataaactacaagaatccgagcagtggcttgaaggtcaaataattgataaaattgatcgctattataccgaagatgtagaaatttttaactcgtctttcgctaaatctaagatgttaacttatgtagatgatgcagatcattctgtcattggttcatcagcgactattcaaatggttcgtgaagtacaaaacttctataaaacacctgaagcaggtattaaatacaataatcaaataaaagatcgttctatggaatctaatacgttttcatttaattctggacgaaaggttgtaaatcctgatactggtttagaagaagatgtattatatgatgttcgtatagtatcaacagaccgagattctaaaggaattggtaaagttattattggtccatttgcttctggcgatgttacagaaaatgaaaacattcagccatatacaggcaatgattttaataaattagcaaattctgatggacgcgacaaatactatgttatcggtgaaataaattatccggctgacatgatttattggaatatcgctaaaattaatttaacatctgaaaaatttgaagttcagaccatcgaattatattctgacccaaccgatgatgttatctttactcgcgacggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaaaacagactcgggggaaaatctcccgagtgatcaatatcgttggattaatttaggatatacagcaaacaatagtttcttttttgatgatgctgatccactaacatcatacatcattagagtagctacagctgcacaagattttgagcaatctgattgggtttatacggaagagtttgaaacttttgctacgaatgcttacacatttcaaaacatgattgaaatgcaattagccaataaattcattcaggaaaaatttactcttaacaattctaattatgtcaattttaataatgacactataatggctgcattgatgaatgaatcgttccaattcagcccatcatatgttgatgtttcatcaatcagtaattttattattggtgaaaatgagtatcatgaaatacaaggttccattcagcaagtatgtaaggatattaaccgagtttatttgatggaatcagaagggattctatatctttttgagcgttatcaacccgtggttaaagtatctaatgataaaggacaaacctggaaagctgtgaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagcaatgcacctatagattctgatccattatctccaacatattcggaaaggctatttgaacctgatacaatgactataactggaaatcctaaagcagtatgctataaaatggattctattggtgataaagtttttgctcttattatcggtgaagttgaaacattaaatgctaatcctagaacgtcaaaaataattgattctactgataaaggaatatatgttttaaatcatgacacaaaaacgtggaaaagagtttttggcaacactgaagaagaaagaagacgtattcaacctgggtatgcgaatatgtcaactgatggtaaattagtttctctatcttcgagtaattttaaatttttaaatgataacgttgttaatgaccctgaaactgtagcaaaatatcagttaatcggtgccgttaaatatgaatttcctcgtgaatggttagctgataagcattatcatatgatggcatttatagcagatgaaaagtctgattgggaaacttttacgcctcagccaatgaaatactatgcagaaccattctttaactggtctaaaaagtctaatacacggtgctggataaacaactctaatagggctgtggtagtttatgcagatttaaaatatactaaagttattgaaaattttccagaaacatcgccagatagattagttcatgaatactgggatgacggcgattgcactatagtaatgccaaacgttaaattcacgggatttaaaaaatatgcgtctgggatgcttttttataaatcctctggtgaaataatttcttattatgattttaactatcgagtgagagacacggttgaaataatttggaagccaactggaatatttttaaaagcatttttacaaaaccaagagcatgaaactccttgggcaccagaagaagagcacggattagctgaccctgatttaagaccattgattggcacaatgatgcctgattcttatttgttgcaggattcgaattttgaggcattttgcgaagcatatattcagtatctttctgatggatatggaactcagtataacaatttacgaaatttaattcgtaaccaatatccacgagaagagcatgcgtgggaatatttgtggtcagagatatataaaagaaacatttatttaaatgctgataaacgtgatgctgttgcgagattctttgaatcacgtagctatgatttttattctactaaaggaattgaagcatcatacaagtttctttttaaagttctttataatgaagaagttgaaattgaaattgaatctggggccggtactgaatatgacataatcgttcaatctgattctttgactgaagatttagtaggacaaacgatttatacggcaacaggaagatgtaatgttacttatatagaaagaagttattctaatggtaaattgcaatggaccgtaactattcataatcttttgggaagattaattgctggtcaagaagttaaagcagaaagactccctagttttgaaggcgaaattattcgtggagttaaaggaaaggatttgcttcaaaacaatatagactatattaatagaagtagatcatactatgtaatgaaaattaaatccaatttaccttcttcccgctggaaatctgacgttattcgttttgttcatccagtaggatttggatttatagcaattacccttttaacgatgtttattaatgttggtttaactcttaaacacacagagacaataattaataaatataaaaactataaatgggattctggattgcctactgaatatgctgatagagtagctaaattaactccaaccggtgaaattgagcatgattcagtaacaggcgaagcaatttatgagcctggcccaatggctggtgtaaaatatcctcttcctgatgactataatgctgaaaatagtaattcaatatttcaaggtcaattgccttctgaacgacgcaagttaatgagtcctctatttgacgcatctggaacaacatttgcacagtttagggatttagttaataaacgtctaaaagataatataggaaatccaagagaccctgaaaatccaacacaggttaaaatagatgaatgattcaagtgttatctatcgtgcgatagttacttcaaaatttagaacagaaaaaatgttgaatttttataattcaattgggagtggtccggataaaaacactatctttatcacatttggaagatcagaaccgtggtcatcaaatgaaaatgaggtgggctttgctccaccttatccaactgattctgtattgggtgtaactgacatgtggactcatatgatgggaaccgtaaaggttcttccatctatgcttgacgcagttattcctcgtcgagattggggagatactagatatccggatccatacacatttagaattaacgatattgtagtgtgtaactcagctccttacaacgctactgaatcaggcgcaggctggttagtatatcgttgtttagatgttcctgatactggaatgtgttcaattgcatctttaactgataaggatgaatgccttaaattaggcggaaaatggacaccttctgttaggtcaatgactcctcctgaaggtcgaggagatgctgaaggaacaattgaacctggggacgggtatgtatgggaatatctttttgagattccacccgatgtatctataaatagatgcacgaatgaatatattgtggttccttggcctgaggaattaaaagaagacccgactagatggggatatgaagataatctcacttggcaacaagatgattttggattaatttaccgggttaaggcaaatactatccgttttaaagcatatttagattcagtttattttcctgatgctgcattgccaggaaataaaggatttagacaaatatcaataatcacgaatcctcttgaagctaaagctcatccaaatgacccaaacgttaaagctgaaaaggattattatgacccagaagatttaatgaggcattcgggcgaaatgatttatatggaaaataggccacctattattatggcaatggatcaaacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcagcgtaaaatggcagtagcaaatggcactggagcagatggtcaaattatccatgctactgggtattatcaaaaacactctattacagagtacgcaactccagtgaaagttggcactagacatgatattgatacctctactgtaggtgttaaagttattattgaaagaggcgaactcggcgattgtgttgaattcattaactctaatggatcaatatcagttactaatcctttaacaattcaagctattgattcaattaaaggtgtttcaggtaatttagtagtaactagcccatatagtaaagtaactttacgctgtatttcatctgataattctacatcggtttggaattattctattgaaagtatgtttggacaaaaggaatcaccagctgaaggtacatggaatatttctacatccggatcagttgatattccactatttcatcgcactgaatacaatatggctaaattgttagttacgtgccaatcggtagatggaagaaaaattaaaacggcagaaataaatattcttgtagatgctgttaattcagaagtcatttcttctgaatatgctgtcatgcgggttggaaatgaaacagaagaagacgaaatcgctaatattgcatttagtattaaagaaaattatgtaacggcaactataagttcttcaactgtcggtatgagagcagcagttaaagttatcgctacgcagaaaatcggggtggctcaataatgaaacaaaatattaatatcggtaatgttgtagatgatggtaccggtgactacctgcgtaaaggtggtataaaaataaatgaaaactttgatgagctttattacgagcttggtgatggagatgttccatattcagccggtgcctggaaaacttataatgcttcatcaggacaaacattaacagcagaatggggaaaatcatatgctattaacacttcatctggaagagtaactctacaacttcctaaaggaaccgttaatgattataataaagtaattaaagctagggatgtatttgcaacatggaatgttaatccagttactctagtagccgcttctggtgatactattaaaggatcatcgtcatcagttgaaattaatgttcaatttagcgatttagagttagtttattgtgctccaggacgttgggaatatgtcaaaaacaaacaaattgacaaaattattagttcagatattagtaatgtagcacgtaaagaatttttagtcgaagttcaaggacaaacagactttttagatgttttccgcggaactagctataatgttaataacatccgagtaaaacaccgtggtaatgaattatattacggcgatgtatttagtgaaaacagtgactttggctctcccggagaaaatgaaggagaattgattcctcttgatggatttaatattaggttaagacagccttgtaatattggtgacactgttcaaattgaaacatttatggatggtgtatcacaatggagaagttcatatacaagacgccaaataaaagtactggattcaaaactaacgtcaaaaacgtctttagaaggaagtatttacgttactgatttatcaacaatgaaatcaattccattttctgcatttggattaattcctggagaacctattaatcctaattctcttgaagttcgttttaatggaattttacaacagcaagctggaacagcaggatatcctctgtttttgtgtgaaggtgctaactcagatacgcaagcaggatgtatatctcttggtggtgaatggaaagaatcgaacacagattattctatagaatatgaagatggaaaacctgtcagtcttttatttgatagaaaatttgaatcaggtgatataatcgttataacatggtttaataatgatttaggaactcttttagaaaaagatgacattattgaattaactgatgaccgttatgttagtaaaggatcatctactgaagttactggggatgtagccttaacagattttgataaaatcggttggccaaatgttgaaaaagttgattcttatactagaacgtataattcaatatcatctattttcgacagcatttatcctgttggttcaatttatgaaaatgctataaacccaaataatccggtgacttatatgggatttggttcatggaaattatttggtaaaggacaagttttagtaggatggaatgatgatgttacggatccaaactttgctttaaacaataatgatttagattctagcggaaatccttcacatactgccggtggaacagttggtacaacatcagtaacgcttgaaaacgcaaatcttcctgcgactaaaactgatgaaagagttttaattgaagacgaaaatggatcagttattattggaggatgtcaatatgacccagacgaaactggtcctatatatacaaaatatcgtgaagactacgcaacaacaaactcttcacatactcctcctactaatattagtaatattcaaccgtctattactgtataccgttggataaggattgcataatgagtttacttaataataaagcgggagttatttcccgcttagcagattttcttggttttagaactaagaaaaatgatatttcggttatgaataatcagccggtaggcgctgtaacaatttcacaaatagcaaaaggtttttatgactcaaatgtagaatctgctatcaatgatgttagaaatatggcagagcaacaggttggagctgtattaattaatataagcggcgtatctcctactggcgtgcaacaaaccgactattggtcatttgaaggaactgttactgatacttcagccaaaccaggtgacccagttattgttaacatgtttggtattccagttaaagctactaatggaatgacttcaattgaatttactagtgctgttagaacagctctacaggaaatggttgtaaaatttattgcaattgattcatttgaagaccatcctaccatagggaataaaatacaagttaagtatttagataaccaagaacatatcttagaacaatactctgataaaggaattactttcaaacaagaaataatttctccttctaaacccgggtatggaacttggcaattattaggtgcgcaaactgttacgctagatagtcacacacaacctacagtattttattattttgagagaatagcatgagtaacaatacatatcagcacgtatcaaatgaatcaaaatatgttaaattcgatccagtaggatcgaattttcctggcactgttacgacagtacagtctgcattatcaaaaataagtaatatcggcgtaaatggtattcctgatgcaactatggaagttaaaggaatagcaatgattgcatcagagcaagaggttttagatggaacaaataattctaaaatcgttacaccagctacattagcaacaagattattgtatccaaatgctactgaaactaaatatggtttaacgcgctattcaacaaatgaagaaacattagaaggctcagataataattcatcaataacgccgcaaaaactgaaataccatactgatgatgtgttccgaaatagatattcatctgagtcatcaaacggggttattaaaatatcatctacgcctgcggctttggctggtgttgatgatactacggcgatgactccgctaaaaacccaaaaactcgcaataaaattaatttcacaaatagctccttccgaagatactgcatcagaatctgtgagaggtgtggttcaattatcaactgttgcgcaaactcgtcaaggaactctccgcgaaggatatgcaatttctccgtatacctttatgaattctgttgcaacacaagaatataagggtgttatacgtttaggaacacaatcggaaattaacagtaatttaggagatgttgcagtaacaggtgaaacactaaatggtcgaggagctactggttctatgcgtggagtagttaaattaacgacgcaagccggtattgcccctgaaggtgatagttctggagcattagcgtggaacgcagatgtaattaatacgcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggcgattggaataatcctggcgttcctgatatgcggggtcttttcgtcagaggagctggcacaggcggtcatattttaaatcaacgaggacaagatggttatggaaaggatagacttggcgtaggatgtgacggaatgcatgttggtggtgttcaagcacaacaaatgtcataccataaacacgccggtggttggggggaatataacagaagtgaaggcccatttggcgcgtctgtttatcaaggatatcttggaactagaaaatatgccgactgggataatgcttcatacttcactaatgatggatttgaattaggcggaccgagagatgcccttggtacacttaatcgtgaaggattaattggttatgaaactagaccatggaatatatcattaaactatattattaaagttcattactaaggattacaaatgattgaattaaaagatttaccttttgttgatagcgttcctgatgaaggtcaggaacgtatttcatggattaaaaatggtgaagaaatactaggagctagcactaagtatggaaacgatggatcaatgaatagaccaattgtttccgtgtttaaaaatgttgaggttcttgacgaaaatataggaattcttaaaactgccattgaaacatcgcagaaagatattaaaacaattcaaggagttttagatgtatcaggagatatagaagcactatcgcagatcagtgttaataaaaatgacatatcaaatttaaagacacttactaatgaacacactgatatattaactggaactaataatacagttgacaaaattattgctgatataggtccatttaatgatgaagaaaactctgtttatagaacaattagaaatgatttattgtggattaaacaagaactagggcaatattctggccaagacattaacggtcttcctgttgttggtaatgctagcacaggaatgaaacatagaataataacaaatagtacattattatcttcacaaggcattcgtttaagtgaattagaaaataaatttactgaatctgacgtaggatcattgacggttgaagttggtaaattacgcgatgaacttggtaataaaccagtagattttggaccaaatatttataatagattaaacactatagatgataaacaaactttaataaattctgatatagcagaaattaaatcttctattggatacccagaaaatgtttctataataacagaaattaataataacaaaagtagcattgaatctattaataatgaattaaatcagagtgaaggtgttaaacagcgcttaacggctattgaaacttctataggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctataaaaacgaatgaaactaacattgcggcagtcacgcatgaagtaaatacagctaaagacaatatatcctctttacagagcagcgttcaagctctacaagaagcgggttatattcctgaagctccaaaagatggccaagcttacgttcgtaaagacggcgaatgggtactactttctacctttttatcaccagcataacatggggccgcaaggccccaaaggattttaaatgtcaggatataattctcagaatccaaaggaactcaaagatgtcattctaagacgtttaggggctccaattattaatgttgagttaacacccgatcaaatttatgattgtatccagcgtgccctagaattatacggtgaataccattttgatggacttaacaaaggttttcatgtattttatgtaggagatgacgaagaaaaatataaaactggagtcttcgatttaagaggttcaaatgtattcgcagtaactcgcattttgcgaacaaatattggatcaataacgtcaatggacggaaacgctacatatccatggtttactgattttcttttaggaatggctggtattaatggcggtatggggacttcttgtaatagattttatggaccaaatgcctttggagctgatttaggatattttacccagcttaccagttacatgggaatgatgcaagatatgctctctcctattccagacttttggtttaattcagcaaatgaacagctcaaagtcatgggaaacttccaaaaatatgatttaattatcgtagaaagctggactaaatcatacattgatactaataaaatggttggaaatacagtaggatatggaacagtcggtctacaagatagctggtcattatctgaacgatataataacccagaccacaatttagttggtcgtgttgttggtcaagacccaaatgttaaacagggtgcttataataatcgttgggtgaaagactatgctactgctttagctaaagaattgaatggtcaaattttagcacgccaccaaggtatgatgcttcctggcggtgttacgattgatggacaacgcttaatagaagaagctcgattagaaaaagaagcattacgtgaagaattatacttgctcgatcctccatttggaattttggtaggttaatatggctacttatgataaaaatctttttgctaaattggaaaaccgcactggttattctcagaccaatgaaactgaaatactaaatccttatgtaaatttcaatcattataaaaacagtcaaatattagctgatgtattagtagctgaaagcattcaaatgcgaggtgtagaatgctattatgttccaagagagtatgtttcccctgatttgatatttggcgaagacttaaaaaataaatttactaaagcttggaaattcgctgcatatttaaattcatttgaaggatatgaaggagctaaatcgttctttagtaactttggtatgcaagtacaggatgaagttactttgtccattaatccaaacttgtttaaacaccaagttaatggaaaagaaccgaaagaaggcgatttgatatattttcctatggataacagcttatttgaaattaactgggttgaaccatatgatccattttatcaattaggtcaaaacgctattcgtaaaattacagcaggtaaattcatttattctggagaagaaattaatccagttctacagaaaaatgaaggaattaacattccagaatttagtgaattagaactaaatcctgttcgcaatcttaacggtattcatgatattaatattgatcaatatgctgaagtagatcaaattaattctgaagctaaagaatatgttgaaccttatgttgttgtcaataacagaggcaaatcttttgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcgataaattcacaagaagatgtggccaaggttgaaactattctacctcgtataaatttgcatttagttgattttagctataacgctccatttaaaacaaacattttaaatcagaatttactgcaaaaaggtacaacttctgtagtatcgcagtataatccatctcctattaaaatgatttatgaattgagtatctttactcgttacgaagacgatatgtttcaaatagttgaacagattcttccatattttcaacctcattttaatacaactatgtacgaacagtttggaaatgatattccatttaaaagggatattaaaattgtactgatgtctgctgctatagatgaagctatagatggagataatttatctcgtcgtagaatcgaatggtcactaacatttgaagtaaacggatggatgtatcctccagtagatgatgcagaaggattaattcgtactacttatacagattttcacgccaatacaagagatttgcctgatggcgaaggtgtttttgaatctgttgatagcgaagttgttcctcgagatattaacccagaggactgggatggaacagtaaaacaaactttcactagcaatgtaaatagaccaacaccgccagaacctcctggcccaagaacatagaggttattatggaaggtcttgatataaacaaacttttagatatttctgacctccccggaatcgacggggaggaaattaaagtatatgaacctctacaattagtagaagttaaaagcaatcctcaaaaccgtactcctgacttagaagatgattatggagtagttcgtcgaaatatgcattttcaacaacaaatgctaatggacgcagccaagatttttcttgagacggcaaagaatgctgattctcctcgtcacatggaagtatttgcaactcttatggggcaaatgactacgacgaacagagaaatactgaagcttcataaagatatgaaagatattacatctgagcaggttggcactaaaggcgctgttcctacaggtcaaatgaatattcagaacgcgacagtattcatgggttcaccaacagaattaatggacgaaattggtgatgcttacgaggctcaagaagctcgtgagaaggtgataaatggaacaaccgattaatgcattaaatgatttccatccattaaatgaagctggaaaaattttaataaaacacccaagcttagcagaaagaaaagatgaagatggaattcattggataaaatcacagtgggatggaaaatggtatcctgaaaaattcagtgattatcttcgtttacacaaaatagtaaaaatcccaaataattctgataagcctgaattatttcaaacttataaagataagaataataaaagatctcggtatatgggtcttcctaacttaaaacgagctaatattaaaacacaatggactcgtgaaatggttgaggaatggaaaaaatgccgagatgatattgtatattttgcagaaacatactgcgccattactcatatcgactatggtgtcataaaggttcaattacgtgactatcagcgtgatatgctcaaaataatgtcatctaaacgtatgactgtttgtaatctatcacgtcagcttggtaaaacaactgtagtagctatttttcttgcacactttgtatgttttaacaaggataaagctgtaggtattcttgcgcacaaaggctcaatgtctgcggaagttttagaccgtactaagcaagcaattgaactgcttcctgactttttacagcctggtatagttgaatggaataaagggtctattgaactagataatggttcttcaattggcgcttatgcttcctctcctgacgcagttcgtggtaactcgttcgcaatgatttacattgacgaatgtgcatttattccaaacttccatgattcatggcttgctattcaaccagtaatttcatctggtcgtcgttcgaaaattattattactacgactcctaatggattaaatcatttttatgatatttggactgctgctgtcgaaggtaaatcaggttttgaaccatatactgctatttggaattcagttaaagaacgtctttataatgatgaagatatttttgacgatggatggcaatggagcatacaaaccattaatggttctactttagctcaatttcgtcaagaacacaccgcggcgtttgaagggacttctggtacattaatttcaggtatgaaattggctgttatggatttcattgaagtaactccagatgatcatggttttcatcgatttaaaagccctgaaccggatagaaaatatattgcaactctagactgctcagaaggtcgtgggcaagattaccacgctttacatattattgatgttaccgatgatgtgtgggagcaggttggtgttttacactcaaacactatttctcatttaattctacctgacatcgttatgcgttatttagtagaatataatgaatgcccagtttatattgaattaaatagtactggtgtgtcagttgcgaaatcactttatatggatttagaatacgaaggcgttatttgcgattcatatactgatttaggaatgaagcaaactaaacgaacgaaagcagtaggatgctctacattaaaagaccttattgaaaaagataagcttattattcatcaccgtgcaactattcaagagtttagaacgtttagtgaaaaaggcgtgtcttgggcggctgaagaaggttatcacgacgatttagtaatgtctttagtaatttttggatggttatcaacacaatcaaaatttattgattatgctgacaaagatgacatgcgactagcatctgaagtattttcaaaagagcttcaagatatgggtgatgaatacgctccagtcatatttgttgattcggttcattctgctgagtatgttccagtatctcaaggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaatgaagtagatttagttaatacttttggtcaaccaaccgctgaaactgctgactattttatgtctgcgatgaatttcttacagtatggaaatgacttacgagtagttcgtgctgttgatagagataccgctaaaaactcatctccgattgctggtaatattgaatacacaatttctaccccaggtagtaactatgcagttggagataaaatcacggtcaaatatgtttcagatgatattgaaactgaaggtaaaattactgaagtagacgcagatggaaaaattaagaaaattaatattcctactgcaaaaattatcgctaaagcgaaagaagtcggtgaatatccaacactaggttctaactggactgcggaaatttcttcatcttcctctggtttagccgcagtaataactcttggaaaaattattactgattctggtattttattagctgaaattgaaaatgctgaagctgctatgacagcggttgactttcaagcaaatctcgaaaaatacggaattccaggagtagtagctctttatccaggcgaattaggcgataaaattgaaattgaaatcgtatctaaagctgactatgcaaaaggagcttctgcattactcccaatttatccaggtggtggtactcgtgcatctactgctaaagcagtatttggatatgggccgcagactgactcacagtatgctattatagttcgtcgaaatgatgctattgttcaaagcgttgttctttcaactaagcgtggtgaaaaagatatttacgatagtaacatctatatcgatgactttttcgcaaaaggtggttcagaatatatttttgcaactgcacaaaactggccagaaggcttctctggaattttaactctgtctggtggattatcatcaaatgctgaagtaacagcaggagatttgatggaagcttgggatttctttgctgatcgcgaatctgtagatgttcagctttttattgctggttcttgtgccggtgaatctttggaaacagcatctactgtccaaaaacacgtcgtttcaattggtgatgctcgccaggattgcttagtattgtgctctcctccgcgtgaaactgtagttggaattcctgtaactcgtgctgttgataacttagtcaactggagaactgcagcaggttcatacactgataataactttaatatcagttcaacttacgcagcaattgatggtaactacaagtatcagtatgacaaatataatgatgtgaatcgttgggttccattagcagctgatattgctggtttatgcgcaagaactgataacgtatctcagacttggatgtctccagctggttataatcgtggccagattcttaacgttattaaacttgctattgaaactcgccaggctcagcgcgaccgtttataccaagaagctatcaacccggtaactggtacaggtggtgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccagtacttacagggaattaaagctctcggtggaatttatgaatatcgtgtagtttgcgatacaacaaataacactccgtcagtaattgatagaaatgagtttgttgcaacattctacattcaaccggctagaagcattaactacattaccttgaacttcgtagcaactgctactggtgcagatttcgatgagttaactggtcttgctggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagtcggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagagcgctattgttcgtcaatatgctcgtgatgctaaaacagtaacaaaagaaattgaaattaaaggtctgtggcctactaacgtgggtgaacttcaattagattgggattcaaacaatgaaatccaaacctttgaagtaaatcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaaccactcgtgagcttattgatacatatcgtaatctcatgaataactatgaagtagataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggtgctgataatactggcaatatggaagatattcgttggtttagacaagctctttacatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccgcttaaaacaaatcttttgcttaaaggtataattacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattgctaattgaaacttggggtcaacctggcgaaattattgatggcgtgccaatgcttgaatcccatgatgggaaagacttaggtttaaaacctggtttatacatcgaaggaatattcatgcaagcagaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccacggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgagcacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgccgcaggtcagacttctggcgcagtaactcagattggcccagctgttatgggtatggtacgtcgtgctattcctaacctgattgctttcgatatttgtggtgttcagccaatgaacagcccgactggccaggtattcgcgctgcgcgcagtatatggtaaagatccaatcgcttccggcgctaaagaagcattccacccaatgtatggtccagatgcaatgttctctggtgagggtgctgctaagaaattcgctgctttgaaagcaagtgatactcttgaagtcggaactatttacactcacttcttccaggaaactggtacagtatatctgcaagctacagcagctaaacaaattgattcaggcgcatctgacgcagacaaattagatgctgaaattaagaaacaaatggaagctggtgtactggtagaaatcgctgaaggtatggctacttctatcgctgaacttcaggaaggtttcaacggttctaccgataacccatggaatgaaatgggcttccgtatcgataaacaagttatcgaagctaaatctcgtcagctgaaagctgcttactctattgaattagcacaagaccttcgcgctgttcacggtatggatgctgatgctgaactgtctggtattctggctaccgaaattatgctggaaatcaaccgcgaagttgttgattggattaactactccgctcaggttggtaaatctggtatgaccctgactccgggttctaaagctggtgtatttgacttccaggatccaattgatattcgtggtgctcgctgggcaggtgaatcctttaaagctctgttgttccagattgacaaagaagcagttgaaattgctcgtcagaccggtcgtggtgaaggtaacttcattatcgcttcccgtaacgtagttaacgttctggcttcagttgataccggcatttcttatgctgcacagggtctggctaccggctttaacactgatactaccaagtcagtatttgctggtgttctgggtggtaaataccgtgtatatatcgaccagtatgctaaacaggattatttcactgtaggttataaaggtccgaacgaaatggatgctggtatttactatgctccatatgtagctctgactccgctgcgtggttccgatccgaagaacttccaaccggtaatgggattcaaaactcgttacggtatcggtatcaacccatttgcagaatccgctgctcaggctccggcttctcgcattcagagcggtatgccttctattctgaatagccttggtaaaaacgcttacttccgccgtgtatatgttaaaggtatctaatctttgacgatttaagggaccttcgggtccctttagttgtttttatggtataaataaatcatataaaccaaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaactggtgctacttacgccggcgaagctggatatgtagaccgagaacaaatcacagaattaacagaagagtctaaattaactctcaataagggcgatttattcaaatataataatatcgtttataaagtattagaagatacaccatttgctgatattgaagaaagcgatttagaattagctcttcagattgcaattgttcttttaaaggttcgtctattttctgacgcagcgtcaacaagcaaatttgaaagctctgatagtgaaattgcggatgctagattccagattaataaatggcaaaccgcagttaaatctcgtaaacttaaaactggtatcacagttgaattagcacaagatttagaagcaaatggattcgatgctcctaatttcttggaagatttgcttgcaactgaaatggcagatgaaatcaataaagatattctgcagtctttgattacagtgtcaaaacgctataaagttacaggaattactgatactggattcatcgatttgagttatgcatctgcacctgaagctggtcgttcattataccgaatggtatgtgaaatggtttcgcatatccaaaaagaatcaacttatacagcaacgttctgtgttgcttcagctcgtgctgctgcgattcttgctgcatcaggttggttaaaacataaaccagaagatgataaatatctttcacaaaatgcctatgggttcttagctaatggtttaccgctttattgcgatactaacagcccattagattatgtaatcgttggtgtagtagaaaatatcggtgaaaaagaaattgttggatcaattttctatgctccgtatacagaaggtcttgacttagatgaccctgaacatgtaggtgcatttaaagttgtagttgacccagaaagtttgcagccatctatcggtttattagttagatatgctttatcagcaaatccttacactgtagcaaaagatgaaaaagaagcaagaataattgatggtggagacatggataaaatggcgggtcgttcagatttgtctgttttattaggtgttaagctaccaaaaattatcgttgatgaataaaacaaagggacctttcggtccctttttatttaacttaccaattcaatccaagtcggacgaagtacatcttgtaccattttaactaattcctttttaaccaaagaaggattatctgcttgagttagagtaataccttcacgagaagtttcttccaaaatatcttgaacagttagtcccatcacctttccaaaatccttcggaccaatttcaccaattttagaaataacgttatttactcggttcagtgtaacgtagcaagctaaaattcccaccaatttgttatcagcttctgatagttcaactttagctttaataggcttatcagactttttcttttcactaaatttggaattcttgcatttgatggctacacgatttccattatgaagccaagaaggataacaaggtttcaatacatatccttcagcggtaaatacttcgcctttggcttcagctttccaaacacatttgttagcgtcaactaatccagcatggtctactgtaaaattataatcttggacgacagaatctaaatcatttggcaatttaataagttcttcaaatttaccacgacctaaaagtggagccattttaaatttaaatgtattacaaaatgattccatcatataatcatcgacataagtcacatcaccactttctgtagtgacaataatgtcaaatacataaaaatctttatcgccataatcgacattcttctgaatgccaggtccagcgaattcgccaaagacttgataagatacaaccgctgaggtttccataatatcttgtactgctttaatagaatcttcgtaattctttagaataatttcatacccaaagaaatcttcagcaggaagaatcggtccagtacgtttagcgcaagttactttatcacgctcaataatcaatgagaaatttgtgccgtgaatcttttcacgagctacccactccccaccagtcaatcccaagctataaagtttttcaataaatttagagttgtaatgattttcaagactgctatactttttaaacataattaatcctcaaaatgtaatttctaaccaatcaccatcacgctgatcactattgactttaaagctgaatccttcttttctcagccaatcaccaatttcttcagtaatcaatttatcgcgagcaatacaataataactaaaatgtgttttaccttgttcagctgctttattagcaagttccgaaaaatctttaataaaacactctagcttaaactgtttacttttaagtgctttttcgcgcaattgattagcaaaagattcattttcataaagatcatactgttccatttttcacctttttattgatatgtctttttctatagacgactttttctcgagtttcaaatttatttttagcagtcatagctcgagcccataatacagccacttcttttgcctgtaagtttaattcacgagcaatttcaatgaatgactttccagactcatgaagagtaaacaccacaacctcagttctcataatcaatctcatgttatcgagttggtgccattatatacatcattttctgattgtgttttgtgtgctttcaaaatgaagaaaggggccgaagccccttatgattatggataggtatagatgataccagtttctaaagcagttttatgaatgatgtatccattacgcgattcttgaacatcaacttctggatagtctttcatcatcttctgaagagtgtaacgatgtaggtaatatttactatctgggtcgtcagttttccaatctttaccttcttcggtcattttttggatttcatccataacccaccaaccgcaccagatataagctgaagtacgatgtggaagaggatgaacataaggtagttcaccttctggttctggagcaactttatcagttacctgaacttgaccttctgctgtaatagttttgctatcgtaatcagttgcagtaacgacagcagtaacttcaatagtttgacttccaacagatgaggtatcgacagtatatacgttagttgacccttctacaggagaagaatctttcttccatgagtaagtaatttgtgcttcttctggagcacccgtaacattagccgtaaatgtagccgaagcatcttgctgaacattaatagaaggaggagtcaatgtaacctgtggattcattgtcttcttattaactgtcaatgatacttcattagaagtaacttccttttcattgtaattttcagcagttacttgggctacgcatttaattctttttactccacttgtagttggagtatagctaaatgtagagttagtttctccaccaacttgtgaatcatctacataccactgatacgtagcagacgctccatcaggttgagaagctaaggcagcagtaaattgaactggggttccaattactccagctgaaggactatcaggagttactgccaaggtagttgtctgcgtctttttattaacagtcagtgacacttcattggaagtaacacttagtgcatcataatctgtcgcagttacttgagctacacacttgatttttttaactccgcttgtggtaggagtgtaattgaatgtagcagaagttgcttcgcccacaggagaaccgtcaacgtaccattgatacgtagcgtttgcacctgatggctgtgaagctaaggcagcggtaaattcaattggagttccaatcactccagcatcagggctaccaggagttactgccaaagtagttgtttgtgtcttattttgaactgtgatagttgtactaatttcagctgtttcaggttcagattctgcaacttgattggttgcaactactttaatagtcttttgaccggcaggtccttttagtacataactaaaagttgctgacgtttcttcctgtggagcgtcgtctacagtccaagcatatgtaatagttccgcctccagtttcaccactgggtgtagcagtaaactgcttagtttcatcaataacccctgtcggtgttttaggagttatatcaactgtaaaagtcataagttatccttattttaatgttacgaaagaagagttgcgtgtttcacgaattagaactgatccgtcacggttaatgtaataaattaagctaaataaagtttggtgtgctgacgcatgttcaaaactagttgggtgagatttccaatcaggagtttcagcaatccattgataaatccaccaaggaacagtacagaatcctggattttttccaatcaactgaagattcgggctaaagttttccggaagagtaaatacagacggcttttcagattcaataatctcagctacagcctgttcaaatttttcttcaacaaatggagtatcttcaatcaaaacatcggtattttcaggaattttatctgtttctactacttcaattttaatgtcagatttaaccggagaatcaatcaaaagtgctgcttctggattgacttcttcatcgtcatattttaacccctctgcagcatcagcagcatcaattaagtctttaatagataacccatcagtctccggcataggttcactagcgagcttctggagagcttcttcaatatcattaacgatattatcaaaagatttattctttttgacctttataccaaactgttcagcatattcagctaatttagctttagcttctttattatcatcaagagccttcagctctgcaatataatctttatctatcataatatttcctcagtataaatatagatatatttattacatggtatttagacatgactgacattaaagtacatttttatgattttagtcacgtgagaattgattgcgaagaaagtacatttcatgaactccgtgatttctttagctttgaagctgatgggtatcgttttaatccgaagtacaaatatggccactgggatggacgaattcgtcttttagattataatcgccttcttccattcggtttagtcgggcaaattaaaaagttctgcgataactttggctataaagcctggattgacccacagattaacgaaaaagaagaattatcaagaaaagattttgatgaatggctttctaaattagaaatctattcaggaaataaaagaattgaaccgcattggtatcaaaaagatgcagtgttcgaaggattagttaatcgtcgtagaattcttaatcttccaacatccgctggtaaatcgttaattcaagctttgcttgcgcgatattatttggaaaattatgaaggtaaaattcttatcattgttccaacaactgctctaacaactcagatggctgatgacttcgttgactatcgtttattcagtcatgcaatgataaagaaaattggtggcggagcatcaaaagatgataaatataaaaatgatgcaccagtcgttgttggtacatggcaaactgtagtaaaacaaccgaaagaatggttctcacagtttggaatgatgatgaatgatgaatgccatcttgctacaggaaaaagtatttcatctatcatatcaggtttaaataactgcatgttcaaatttggtctatctggttcattacgtgatggcaaagccaatatcatgcagtatgttggaatgtttggtgaaatatttaagccagtaacgacttctaagttaatggaagatggacaagtaactgagctaaaaattaatagtatttttcttcgctatcccgatgagttcactactaaattaaagggaaaaacttatcaagaagaaataaaaattattacggggcttagtaaaagaaataaatggatcgctaaattggctattaagcttgcacaaaaagatgaaaacgcttttgtcatgtttaaacatgtatcacatggtaaagctattttcgatttaattaaaaatgaatacgataaagtttattacgtatcaggggaagttgataccgaaacccgcaatataatgaaaaccttagctgaaaatggtaaaggaataattatagtagctagttatggtgtattttctactggtatttcagttaaaaatctgcatcacgttgttttagcgcacggtgttaaatcaaaaatcattgtattacaaacaatcggtcgtgtattacgtaagcatggttctaaaacaatcgcaacagtctgggacctcatagatgactgtggtgtcaagccaaaatctgctaatactaaaaagaaatatgttcacttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgcgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaagaacatcttcaccgcacgggtggtcggccaggatacgaatatcctgacgcttaagattatgctttttcattaagaattgaatttccgtttcaaattcttcttcataattaaaagcatcatcaatgttatatctcattattttccagcctcaaatgctcgcatgtcttgaatatgcttaatagcaaatccacgtgatttaatagcatcaagagctccgctacagaaatctaataaaatcccccaatactgtaacgaggtatcaacctttaaaacatccttatcagctgatagaactgtcttcatttctgatttctcgtaacgatccatactaaattcatcaccatctcctcgtcccgagtagtagtctaatttagctttaagagcaacttttttctgtgcttcaattctaagcatttcctttttaatacttgaatgcttattaagccatttactatataacatcacattattagctgcttcatactgtaatttagtcgaatctataaacacatctttcttcaattcttcttgaagatcttctaatctcatattgttctctattcaattgttattggatggacttagattcattataccacgtttatacgtgaagcattatactctattactggaagccagttgtagttttatctgctcaatatcatcagggttatcgatgaccgaaaagcgtatttctactatcagagtataatcatcataaactggtatcacattaactgctaatttatcaatacgtggctcatagtttcttactgcgctttcgatattgcgctcaactgtgtcagcagtaagaggagtcatattttcaaaaagctggtctgataaatcacatccaaattcagggtcaaacggtcttgaaccttttcttgttgtaataattcccaaaagactgtttttaattgaccttaatccaagcgatctggaaacatctttgttccaatccattttcatttctgggtcaatgtcagaataaagcttattaatatttgccattatagtaactcaaagaactctttgaggcctcttattacatgagcatgggtttttccacactctggacacttaattggaacagccaaataaacggtaggttttaaaagcatatcttttatagctacaatatctgactctgtgatgatagaatataaatcttctagttccttttcatttaagtcttcaactggaatgctttccccgttagcatgaatcgtttctatgcatgatactatcatgtgggctatatttttatcatcaaaaattttagggtatcggaatttaattttaatgtcacccagtgtataccagaggtcttctggtgcatctatttgtgtatgtaatagatttatatgggttggtatttcagttccacaggtgcacttccaagagttttcgtgattaacttcaccaagagaatgcgcccataaatgaatcagtaatagttctgattcttggcggtttaaatcttttgcatttgtacagtctttgattagctttttaacaatctcttctactgaaccattctttttagcagtaataagttctagatattctttaagcgtgaatgcgcgacaattgattattttagaaccaactctcacatcaaatttgtattcatacatattttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagagcatcggtcaccacaagaacaaaaagaaataattactgatttaattgatgattattttggagactatccgaagacttggcaaccatttatatttttgcaggtatttgtagggtcaataggtaaaactaaagtaccagtcacatttgtatgtccaaaatgtaaaaaagaaaagacagttccatttgaaatatatcaaaaagaattaaaggaacctatttttgatgtagctaatgttaaaattaaattaaattttccttctgagttttatgaaaataaagcaaagatgattactgaaaatattcattctgttcaagtagatgaaatgtggtatgattggaaggaaattagtgaatcgagtcaaatagaacttgttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgagcgcggattcgtattaaaactgattgagaaggataaacatcaatgagtatgttacaacgtcctggatatccaaatctcagcgttaaattatttgagagttatgacgcttggagtaataatagatttgttgaattagctgctactattaccacattaactatgcgtgactctctttatggtcgaaatgaaggaatgctgcagttttatgattctaaaaatatccacacaaaaatggatggaaatgaaataattcaaatttctgtagctaatgcaaacgatattaataatgttaaaacacgaatttatggatgcaagcatttttccgtgtcagtagattcaaaaggcgataacatcattgctattgaattgggaactattcattctatagaaaatcttaaatttggtagaccatttttccctgatgcaggtgaatctataaaagaaatgcttggtgtcatttatcaagaccgcacattattaactccagcaataaatgctataaatgcttatgttcctgatattccatggactagcacatttgaaaactatttgtcatatgtaagagaagttgctctagcggtaggaagcgataagttcgtatttgtatggcaagacatcatgggagttaacatgatggactatgatatgatgataaatcaagaaccatatccaatgattgtaggtgagccaactttaataggtcaattcgtccaagaattgaaatatccattagcatatgattttgtttggttgactaaatcaaacccgcataaacgtgatccaatgaaaaatgctactatctatgctcattcatttttagattcttcattaccaatgattactacaggaaagggtgaaaactctattgtagtgtcaaggtcaggtgcttattctgaaatgacttatagaaatggatatgaagaagctattcgtcttcagactatggcgcaatatgacggctatgctaaatgttctactgtcggtaattttaacttgactcctggcgttaaaattatttttaatgatagtaaaaaccaatttaaaacagaattttacgttgatgaagttattcacgaattatcaaataataattccgtaactcatctatatatgttcactaatgcaacgaaactggaaacaatcgacccagttaaggttaaaaatgaatttaaaactgatactaccactgaagaaagtagttcttccgataagtaataaagaagtttctattcctaagatgggtcttaaacattataacattttaaaagatgttaaaggtcctgatgaaaatttaaagcttcttattgattctatttgtccaaatttatcaccggcagaagttgatttcgtttccattcatttattggaatttaatggaaagattaaatctcgtaaagaaatagatggttatacttatgacattaatgatgtttatgtgtgccaaagattagaatttcaataccaaggaaatacattttattttagacctcctggaaaatttgaacaatttttaacggtgagcgatatgttatccaaatgcttgcttaaggtcaatgatgaagttaaagaaattaattttcttgagatgccagcattcgttttaaaatgggcaaatgatatttttacaactttagcaattcctggccctaatggtccaataaccggaattggcaatattattggattatttgaatgaaaaagccacaagaaatgcaaacgatgcgtagaaaagttatttcagataataaaccaacacaggaagcggctaaatccgcttctaacactttatctggacttaacgatatatctacgaaattggatgatgctcaagctgcttctgaattaattgctcaaactgttgaagaaaaatcgaatgaaataattggagcaattgacaatgtagaaagcgcagtgagtgatactactgctggttctgagttaattgctgaaactgtcgaaattggcaataatattaataaagaaatcggtgaatcgctcggaagtaaattagataaattaacgagtttactcgagcaaaaaatccagacagccggaattcaacaaacaggaactagtttagctacggttgaaagcgctattcctgttaaagttgttgaggacgatacagctgaatccgtgggtcctttattaccagctcctgaagcagttaataatgatcctgatgctgattttttccctacccctcagccagttgaacctaaacaagaatcgccagaagaaaaacagaaaaaagaagcatttaacttaaaattatctcaagctttagataaattaacaaagactgttgattttggatttaagaaatctatttcaattagtgataaaatatcaagcatgttatttaagtataccgttagtgctgctattgaagctgctaaaatgactgcaatgatattggctgttgttgttggaatagatctgttgatggttcacttcaaatattggtcagataaattttcgcaggcatgggatttgtttagtacaaactttaccaaattctctagcgaaaccggaacgtggggtcctttattacagagcatctttggttctattgataaaattaagaagctgtgggaagctggagactggggcggattgacagtagctattgtcgaaggacttggaaaggttctttttaatttaggagagcttattcaacttggaatggctaaattatctgcggcaattcttcgagttattcctggtatgaaggatactgctgatgaagtagaaggaagagcactagaaaatttccaaaatactacaaatgcttctcttagcaaagaagaccaagaaaaagttgcaaattatcaatataaaagaatgaatgacgatcttggtccaatagcaaaagggctagacaaaattgcgaactggaaaactcgtgcatctaactggattcgtggtgttgataataaagaagcactaacgactgatgaagagagagcagaggaagaagaaaaattaaagcaactttctccggaggaagctaaaattgctttaatgaaagctaatgaagctcgtgctgctatgaatcgttttgatgaatacgctaattcagctgatatgagtaaagactcaacggttaaatcagttgaagctgcctatgaagaccttaaaaaacgaatggatgacccggatttaaataattcaccggcagttaaaaaagaacttgctgctagattttctaaaattgatgctacttatcaagagctcaagaaaaatcagcctaatgccaaacctcaaacttctgctaaatcgccagaagcaaaacaagtccaggtaatagaaaagaacaaagcacagcaagctcctattcaacaagcatctccttcaatcaataatactaataatgttattaagaaaaatactgtcgttcataatatgacacccgtaacgagcacgactgctcctggtgtatttgatgcgactggagttaattaaggaataatatggcaattgttaaagaaataactgctgatttaattaaaaagtccggtgagaaaatttcagccggacagagtactaaatcagaagtagcaactaaaacatacactgcccagtttccaactgggcgtgctagtggtaatgacactacaggggacttccaggtaacagatctatataagaatggattattatttactgcatacaatatgtcatctagggattctggaagtcttagaacgatgagatctaactactcttcttcatcttcgagtattttacgtacagccagaaacactatcagtaatacagtatcaaaactatcaaatggactaatatcagataataattcaggaacaataagtaaagttcctgttgcaaatattcttttacctagatctaaatctgacgtcgatacgtcatcacatagatttaatgatgttcaagatagtcttattacaaaaggtggaggtactgctactggtgtgctaagcaatatggcttcaaccgcagtatttggagcgctggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatctagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgacaaaacacctaatggtaactttaacggattagctattgctccaaacctccctagtacatttactctcgagattactatgagagaaattatcacgttaaaccgtgcttctttatatgcggggactttttaatgtattctttagaggaatttaataatcaagcaataaacgcagatttccaacgtaataatatgtttagctgcgtttttgcaacaactccatcaactaaaagctcttcgttgataagttcaattagcaacttttcttataataacttgggactaaattcagattggttaggattaactcaaggcgatattaatcagggaattaccacgctaattacagctggcacacaaaaactgataagaaaatcaggggttagtaaatatcttattggtgccatgagtcaacgtacagttcaaagtttattaggctcatttacagttggtacatatttaattgacttctttaacgtggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggctgatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtcatgcaggctggagcagttgataggcaagctgcgcttgaatggcttgaatctgctgctataaatggtattcaaagcgttctcggaaatagtggaggtgttactggactatctaattcgctttcacgactcagtagattagggggaactgcaggaagcatttcaaacattaatactatgacaggaattgtcaattcgcaaagtaaaatattaggagcaatataacaatggggacctttcggtccccatatttttatttacggaatgaaatgaaagcagaaactgaagcaactaaactgtcttcaatataaacttcaatttttaccggagcttctgactcaaatttacctgttactacaccctgaaaaatactttcagtctgttctggctttgaaaaattttcagaaggaaaaattccgaactttttatctgttccaaaaattttgataaattcatcgtaaactgcttcattaaaagcattatcagcaggaataacgccttcaactacaagttcttgacctaaaaagcgcaaagaagatttcattttgtgttcctcatgttatgtcagtaagactactataacacaacacgagggacttgtaaactacattttgaactttttagacattccgttaatgttaaccaaagaagctaagatttgagaaacttcgttttcctcttcttttgattcttctacaaggaattgattaaatccagccattggacgaacttcaccagtttccattagatggtcgccatcatatactgattcttctaattgttcagaaggaggaacgattgtaccttcgattagatacttgttataagcagtttctttcataaagtacgtacttactttattaatcttcagtaaaattccacgcggtagaataacttcagcttctgatggaaatcctgataaatgacctggaacgataactttgattcgctcagctcctttaattaccatacccacactagtttcagcatcttcattagcatatgtagaatgactacccatatgcatcaaatcttctgcatcaacggaaccttctccttcaccagaaaatactgcgccggaatcatctaaggccatatagtttttaccatgctcaccgaaaatatttggtttaagcgatgtggatacgaagttcttgaaatagaacattttgttttcaatgttatgacgcaaagttttaaaggtaacttcttgtccacgataaagcgtagttcctggaggaagaactgaacctttagcgaatgcagaatccaacgtctcgatgtgcttaatagctcgttccatatattcttcacgggtagaatctggtttacccaaaaggaacgagttcatttcaacatatgaatctgcacaataatcttcaattacatcagactcagcctgagtcagtccttttggagttacttcagtacttgcatattcatatgcctgagcagcggattcattaatcaatttataaatgccattcatgacaaattgaataatagctaccttttcatctggtgtggctttagaacctttaactaaatcattgataattttcttaataacatcaaagctattagaaatattaatgtcagcgagatcgcttaaaattttatcggttttataatcaaaaaattctttattctttaaatattcttgagaaccttgatgtgttatatcgctctgcagtctaatagacggatcacgtaaacgcgcatgggccaatgcaatatgatttcggaagctttctagttcataatcgctagatttaaaacgagaagcacttctcataccaccaatagctcctttgccgaagtttgaaccaatctgaataacgccagagttcatcggaccttctgctttatataccggaactttagattcaaactcttgatatttctttgcagcgaagctatcaccctgaagtgaagcatcgacagtagaatattgagcttgtgctgctaatcgacgactaattttagttttttgaataacagcttgatccgtgcgcttatcattttctaaagcaatagaagcagcaacagcgacagctttaggaacagcattacctgttttaacatctacataaacatcaccgacctttgattcaacttttgtgaataactcagttgaaataggaggtacacctggaatgtcttctaatttggcatttttacggtaaaccataatatatgcatatttcttatcatagtcccagatttcctttaaaagaacatatcggcctgctcctttagtacgtactaaacggtcagcaataacttgcatttgacgagcagcgccatttgttttactctttagtacgcggaataagcatgcatcaattttatactgtttcattgtttgaagagcagtatcaaaaacagcattaatgacgccaattggatttccacccaagtttttaagcttaactaatgatagtttctcattaacacctatcattacgatatgcatcattttgtcgcctggcttaacgtttttattcgtatcaccgccagaggtgtatgtacaaaatctaaatccaggaagcacgctttcttcaccggcttgaatagcaaaaatttgtggtattttatgcttaggatttaagttaacaaccggcgccgaagcgccgtcaaataattctgtaataagttccatgatttatccttgaacgaacttgtaaggtatgtttgtaatatctatgcaagacgcaataattccaagagatgattctactttctgtttaacatttgatgaaacaaatgatgcaaagtcaactctgtcttctatttcaatatcacctgtcattgcaactacttcgccggtttccattaaacggtcaccgtcataaattaccgattcggtgagttcttcagtggtcataacttcagcttgaatgagttttgtattattagacgtggttccgtcattattagaagcatcagttattttattaactttgaccatcaatccgcgcggtagaataacttcggcttctgttgctattccgagacttcctggatatacaacattaactttatgagctccatcaattgcccatcctatttgaactttaacgtattcaggattttctttatacgctcttatttcgtttggattaatagttattccttcttcatttttatcaactgttaattcattgcgagcttctggttctaaaagaccaataccagcatgtgtaattccaaaacgcccaaaaatgataggagttaaagaagtagatacaaaatttctgaaatagaatactttatttttaactaacgcttcatatataggagcagtcatactttgagcacgataaactgtaatgccttctggtatacggtcaccattttcaaaagctgaatctaagttatttatagcagattcaatttctttttcactcattacatcatatcgttctggattgtaacgacctaaaagaagattattgatgtcagtatatcctgaaccgcaatattctctaatgccacgcttttgtgatggagtatatttagaaccatcgcgggcaatagtaatatcaatcattggaccagcaccaattccagaaaaactgtaaatcattcgtttgaggaatttagtttttgctgcattccatgcatttttagttatttctccccagacttcatctggttgccctttacgagttttattatgtttatcaagccaattatctttatattcttcaaagaatttattaacagctgctgcgtatttctctaaacattttattgaagtagttggttcatttttgattgcgttaaaaattacatctttaattttttcggaaacttcatcaacctcactttttgaaaagaatttatagtcatagtgaagttcatctgcagttccttcggcaataatttttgctgccttagttttagaagctaatgaattaattccaagcttcatttcttctgcttcgggaattaaaggagcggtagcaggtttattgaaattagctgcggtagattcatacttctggaataattcactttcaaatctagaagattccaatgattgactttgcgcaattgctctacgggaaattttaactttaacgattacagcttggtcagaacgtttatcgttttcttgcgcaatagatgctgcaattgcctcatttttggttacttgagctccagtatctttattgatataaacatcgccgaccttcgattcaactttagtaaagagctcggtactaatttccggaactcctggaatgtcttctagtgatacatttttacgatgtataagaatatatgcatactttttatcgtaatcccagagttccttaagaaggacgtatctgccacctgaacgactacggataagtctatcagcaataagttgaatttgtcgagcttgaccagcagttttagacttaagaatacgaagcatgcaggcatcaattttatactgacgcatcgtctgcattgcaacagtaaaaactgaattgatataattaattgggcttggaccgagaccttttaatttagcaattgaacctttagcagttaatgtaaaaggaacaatatgcatcattttatcgcccatctttaaatcgcgattagtatcacctccagatgtataggtacataaacgaaagcctggttgttcaattgcatcatcaacatgaactgaaaaaatttgcggtattttcttctttggatttaagtttgtaatcggaagagtagtatcttcgtcaaataattctgtaataagttccatcatagcctctctagtgtttattctatttataaaattaaaggcccgaaggcctttagtaatctagtggtaagagagtacgatatatttcaaactttggtcctttttcataggcatcaaatgtttctgtaaatttattataagcgtatgcatctacaaattcgagaatgacttgtgatacagaagtagaaacatctccaccttctttttgagcaacgacaattgtttctaagtaagctttcataaaccagttacctcatgaaaatcgccaaatacatcttcgaacgtattagctttagttttatcttcacgtaaacgaatcgcaatcggaagaaataatttaacgtaatcagtgcggccatcagattttaaccaaccgttgcattcgcactctagaatttttccaatataataattttggttttccataatgcgagtacggtcaagttcatgcgattttacaccggctttatcttttaagcctgaaccagcatttaccttaatttttccacactctgattcaagaataaatccacccgctttagtagggtctttacggtgaggataaattcctacaatttttaaatcaacatcaattacttctttaaatttatagagattttttgaacgagcattttcccacaatccatcggtatttttgagaataataccttcaagaccttggtcaatatactttttataaattaccttagcttcatctaggttatttactacctggttttcaattaaaattactttatcataacctgatgtcatttgttctagtttagaaaaacgtacatcatattttaaacgaaacgccggaagaccgtatatttctaccaacgggacataatcccagacctgaaacttcatgcattgagcttctttttctgaaatagttccctttaaagatttattagcgattccattagaagcagtacgtgattcagctacttcggcgaattctttagctttactaatttcaggataagcatcaaaaagaaaatctaggccttctggctcttttttaacttgctcatggtataccaattcgccatcaattaacacaccttctggatgaatctggcgggcttcagcggtcattttgattaactcttctttgagaaggtctaatcctagatattcattaccagctcgtgataaaagacgaacatcatctaattcatcgcctcggacttcagcaaaacaccgagctccatctgcttttaactgtgcaaaagctggaaatttgatattcttactaatgcctttttcatcataagaacttgccagcatttgaggttgttcaggaattaaacctggccaaactttatttgcgatagatactgaagcaccgcattcaaggtctcgcatcatcacccgacgcaaaacttcaacatcatcctttttaccgtcagtaatatatccagttaattcctcaattgccgcatttccagtcaatttccgagtagctaacgtgaattcaatgaagtcgagcatatcggtaagagtcaacattccaaaactctgggtagcaatacccggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacgtaaatgaaaccttgctctacacattttttaaaaattcgttcgtctttttgagctcggaattctggattgcatctaaaaaattgatttacgtgaccgtaatcacgtgtagtattaccttcattttcataaatagtatgaacaacaaacattagaatgctccttggaaaatattatcaccgctaataggtctattatacaaatactctatgccaccaggtttaatatagttccatgtctgaaacggatgtgtctgatatggatgatatagatgattataaggattaaatccaggagttctccaggtagtgttccaaggaaaagaatcgtttttaattaatatagttccatgtctgaaacggatgtgtctgatatggatgatatagatgattataaggattaaatccaggagttctccaggtagtgttccaaggaaaagaatcgtttttaatcatcttttcaattacatcttttatagctttttcactatcaaaactttctttattttccttcgatggaaaaagcttattctcgacatcattccatgtataaactcgctgtgcagtttttggaatactgtcacgctcccctcgagccatccaataaacaggaacatttaatatttcactcgcgtgatcgcagtggtgagcgagatcgtcaatataacaaattacgttatatttctcttttgcctttttgaacaactcttcttttgaagaatcatgaccacacatcaatacttctgagaaggcaccaggaaaaagagcattcaaattaaattgacgattcagcagagcgtcaatagaatcacccaatgctgtaacagctacaaaattataatcttcttttaatttgttaattacacacagggcatctttatatggagacaagtaacgaataaaatctgaacgattgtatttttcaattaacttgacgccaagttcttcatcacaattaaagagtttaccaggagaaataaatttctcatcttggatcatttttaaaatatgttctaacggaagattatatttctgagcaaaataaggaaggcctgattgccagcttaaacatactccatcaatatcagttaaaatagtaggcttcatagagagtctcttaataggtttaacacatcaataaattcagcttcagttagtattgtatcatcttttgttagaccactagccatgctgtgcttcaaaacttttcctttcgaggcttgtaatgcatcacgaaagcccttgttttggatcgctgcttcaaaatatgcatttgtatacagctctttccacgccggggagtatcttgaaaacggaactccaagccagaagagggtcccacggtcctgagccctagcataagctcgtccagcttgttgggcggcaagcccggataacccaaatatacgtctttgttgttcagcatttttcaccttgcatccttggaggaatccttcaagacctccgaattgaataccatccatgacgaaaggccattgggcgaaattacttaatgcacacgatggccatctaaaattgcttctaatctctaactcagacattttcaatacttataatttcaacatcagcccaatgaccatagcaaggaagacgaaattcaactggccagttagggtccttttctaatataatagacttaacttgtggttcttcatgttcatcagtatatggatttttatctgttactttatatgtgaccttaatgtactgaattccaaaaatcttattaattatattcatactaattcctttaatccgtaaataggagataattcatcacccatacgaaggtcttcatttccatctacccaggaaacaatataagcctcttttatttgaataccactccatttaaatggaggtagaaccttagaaattaatccaggtataccaactccctttaattcaacagtttgacctaaaaagaatttcattagaacctcatctgaaaaccgtgcgatttaacattaccaccgccaatatcagaaatgttaatttcactcgcaattgaagggtcaatgtcaatttcgcgattgagtttagtgatagctaaagtatcacgcccatttacagtacgaaactctaaaggacaaaccacatcaacgtagtttttaatcgattcgctagtaggttgcaaatgagcaggaaggtctttaggcgccttagagaaaaccacttcacagaaatttttgcgggtgtcaaaataagtagtcataaacatagtattttcctcagtaaggggccgaagcccctcattttattttaaatatcaaattcgttaagaactacatcaaagattgcttcaagatgctcaggtttagctctgttactcagaatatgacgaatccaagttttaaccagaagcttgcgattaacgccattccagcaaggatgagtccctaaatcgcgttgacgaaaatcatcatccaaagcgattttaaaagaagaaccttccattgtgattgaaaccgtgatgccattttcaaatcgcatataaacgtagttaggagtcatatattgttcaatttcgcatactgatccattttgatgtttccaaaggcaaatagtatcaatagaacatgcaataccattagaaaaatatttacgttcaaagttgatgtagttcatttttattctccgagatgtttaattgcggtacaggtatataatatcatatcctgtaccaaagtaaactattttatgcaactttaatccaattatctaaatttaattcacctttggctttcattttttcaatcaagaggtcagcggtaatacgaccattttgataccacgtaacatcttcagagtaaccagtttctttatcttcataagtctcacaacgaattttaccaataatcaaagttttcaattcgtatgtatctccagtaaaaaagttagttaacattattttccaagagaaatcatcagaaggaccttcaggagtcatgcaacctacaaattcaaattgttctttgtataagtgccactgaagttctttagtttcgatagctttatagccgtcgtgatctttacctttgatgtatgagttaagattgattttcattttattctcctttgtttgtgtaagataatactatcacaaaggaactatactgtaaacaactttatgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcgacccacgcttgtagccagcgcgtttagaatcaccaactttcttttcaactgctttctttgctttaacttgttttgccattataaattctcttttaaatgaaaatgcaggacttattggcattgcctgcgcaagccctcaaaggggtacttaggttttgaatatttaccgacaggataaccataaacctcgtcatcataccaccaagacttacacagataacacttttctgacgcatgatagtaacattcaagaggtacaccgtaaaactgccggggtcttaaaactataatgattcgcaaatcattaatcagacagttcgacggctcctcgttttaacttcacactaaggcagtgactctccaataaattacttcagtgttaccacaaagtgacgaactgcttttcgtgcagcagaagccaaaggcttagcatatttaagttcatctttttcctgaagctcagcagctagtgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaggtaacaaatttttgtttaatttcttttggctgcttaagacccagagctacaaaaggatgcggaacgtttcgaatttgaccaactggaagagaagtcaaatcaccaacttcacaaaaaccttcaggaacatcaggaccgacagagtgaattacacacagttcaggaacttcaccttgaacacgtttaccgataataagtcctgattctgtaacttcttcatcaccggcttgtgcgggttcagaaactaaaataacatattcaccgacagcacgaattggtagctgttgtacttcagacatcgtttttcctttttgttaacagatgaattaataataacaaataattcttaaagcatttatttaccaataaattggagtaaatgctcaactttcataccattaacagaaatcaatttgtcaatagaaaaacctcgccatgcaccaagttcaacatcaaatactggaatcatatcagtagattctttccgagtagattcagtcaatttaccagtttgcatggttggcataaagtcagcatcgcgagtacctttcatgacacgaatagtaccatcagacttttcaaaaactacgtttgaaacacccatggacaatttagttttcaaaatttcacgaattgctactttctgttcagtcgtcagtttcatttatttacctattacagttttaatatgagttgttccacgttctttaagagtggaaagtaatttttggcatttttctaaatcagatttccaactatgtggtctatcaatacaaacccagtttgacttataatactgcttccatttagagaaaaaatacttcttatactctacagcaaatgaaatgttctcgttggaataagaactaattgctgtgagctgtaccaaacgaaatttcattattcaccacagaattcgttgatattttcccagtttaacttatttaagtttttcttaggaacattaaacacttcaatacccgcatttcgcagaatatcatcccagccaggtttattcttatcgtatgtttcgcaataaaccagttttttaattccagattgagctatggcttttgcacaatccggacaaggagaaagtgttacatacatagtagcaccttcaattgaagaaccatttcgcgcagcaaacaaaatcgcatttagttcagcatgaatttcatttttagacgaccattcagagtgagcactacgatgttctttcgccaagacaaaacgatcagttgaaccaaatgatacacattcaggcttatgaccttgaatgatagtatgtttaggcttattcagcaaccaaccttgctcggcagcataatcgcagcaattcacacccccggcaggtgaaccattatatccggtagaaataatacgtccattcttttcaattactgctcctaccttccaggagcaacattttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcaccaaccatctttttgtgaagctcaaccggatacttcgtcacaataatagcatcatacacagaaggatgaatactattcactagagtatcattcattaaagttattctaatgaactgtgctgtgtcagagtcaagcgctctatgatcgccagtatcattttcaagacaattatcaattatatcagttaaattcatcatagtacgccatacaccctttgtgcttcaactaatccatcaaaatccaatttgagatgtgttatttggtcaccatcacctggattcacaattactaataccgaacgaggagtttcggtaataacacgaaccgacgtttcaggaaatcgttcagaaaccttatttaccaattcttgagcaaatagtttaactttttcttggaattctttaacagtaattggtttttcgcttagcatgttgatcctagctccttactttcaacatttttaactaatttgacagaaactaattcagcatcttgggtaatcattaccggaccttcttcatgctcttcaagatattctagagctttctttttagcttcttccttcgtatcagtttgagcatagatatagaacatacaaccagtaatacctactactttccacttaatttctttatcagttttaatttcaaatttacttacagaatcatctttttgaacttcttcgaaaaaagaatattctaacatataagcaattgaaaataacgggctaactttataggattcacccattacatcaacagctttataccaacaatcatcaatttcacgtttaatgctaataacatttttcgcaggatctatttttactttaaatgaattttccccaataaactgggcaattcgtttattggccccgcaagtttcattaaaaatatctttatatccagctttaaagcgataaaccttatcttcttcaaaccattcgctcatttcaatttcctcatttgttttggtagagctataatatcacaactctaccgtaaagtaaaccattaaatcgctttgaattccgcagtttgagattcaaagcgaatgtcgcctttgataactagctcagcatcaagaccgaatacgacaatgatatgcgcggaacctggatacagcgtaatggcaacagaatccacctggtctggaagcaaagtgttcaatacatgagtcacttgagcatgaattcgaagctcagctgcgttatcaagtttttcaaacatattattagcgataatttggctaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccaactaaaccgctatttacaataacaatagcccaagtttcatggtgccaagccattaaaaatctcccgaagcgacttgccagcattcaacaccgatgcggcgccacatttcaactacttgagttcggtcatcaatagctaatttcacatcaaaatgtggtgcgatgtgtttccagaaaatttcttctttaactacatcatctttacgggtatcgccttgttcgcgttgacactgcatgactaatggaacaccagcaatgtcctcaacccatttacgggtcatacgataatatttcgttggatcttcttcggttccactttcacggcctgaaacgactacgatttgataacccataagagcatacatcttggatagttcaacgaccattggattaataatatcggtatcgcatttttcaaggtcataaggaccacgaccattcatttttgctaacgtgccatcaacatcaaaaataactgcttttggtttaccaggagtccctttatataccggaagaccgagatactctcgcatgcttttatacattgagcgtaaaacatcaattggtactgctttagttccgcgttttgagttgcgtttaaccaattcagtccaaggaacatcaaacactttatgttcaatttgatgcccaagctctttggcaaactcttcccaaaccttacgtcgttcaggattcagattagtatctgaaacaattacacccttcgttgcgtcttggcagagaatcatgttagcaacatcatgctgcatgtaagttacgataccttctttatttttggtatacttgtactcatcgcgttcttcatgtgccataatagattggcgatagtcatcacgattgatattataaaaccctggatttttagcaataaattcacgagcccaagtactcttaccagaaccaggacagccaatagtcaaaataatctttttcatcatttaattcctaagaaaacttcaagaatacgaatattgtgctcacgccgtcctttgtacaattcagctgttgattgattcgctgatttactctgaacattggatgaaataaattttatcatgtgatttttaagctgatacatatcaagcccacgagctttcgcttcttttcgcagggctttaccagcatcatctaaagctttagcagggtcttcatcatttaatactattccacgatccaaatccatgtatactgcaccatgacatgcatcaatgtaacggtccgagcattcaatataacgttctagcagagttttcatttatttttctcaactaatgattgaatataatcatgcaagtctttagatgctttaccccacttattttgatattcatttttgagattagcacgtgattgagctaataaaacatcattagttggaggtaaagattctaaccgctgaatctggcgtccataaatcattgcagccatctcggattcataaatcaatcctttgagatgttcaaattgatgccatgaaatcatttacatttatcctcttttaactcttgacgataataacatatcatagttttttggtcatgtacatatcgttttacatcattaagccaaatacgaaattcctgggaatcttcaaatggcataccgacccaagctttaccatcaataactttaacttgccaagatagtttagcttcatcatatgactttatctgtacaggccaattaggatgaactgtttctttctttacttctagaggctttgtcgaacaaccagctagaagaccgatagataatattactgctgatagtctaatcatttagaaaggtcctggatgtcttctgcgaacttgttgaaggagttgttgatttgtttttcaaccaatcctggcttacgagccaccacatccgccttctttgcatctttgcgcagtttttcattttcacgctcaatagcagcaattgcctcacgatttttattattcatcgcatcaatataattatactgaattcgcaaattatttaatgctaaggcgttttcattggctgtttttgtaatttcagtaactgatgtttctaatctttctaccttattttttaaaataatagatgttccgccaaatgctattacaagtaatagcaatccagctgtaaaattacttacatgcataaagttttaataacctctataatatcgtcttgagaaagaccgttaattaaaatatgatgttcagctggagatttagaaattttaaagcatgcctcaacatcttctgccatatccgatgcactacgatttggattactaattccaagacgatgctttccagtcaaaggattaacgatgatatagcatttacagttgttaatatgaacattaggttgagtctgattaataaatacatcacaatcatatttcgcaagctgattttctaaaaagactttcatctcttcaaccgcatcaggaagcatatcacgggcttgctcaagacgacgatttcgatattctttaatggtcgttttccgcttgacttgcttagctaaatctttcttaagatcggtgatatatccaactcgacggtttcctttaaatacagaaatcccatctgtagtatcaccgtatgcttcaacgaccatttcagtagtaatgagctgcaaatccatcataaagtcctcatgttatgtcagtaagactactgtaacacaacacgagggacttgtaaacagcttagtatccttctgggataaattttttataatttttcaaaaaattctgttcgatttcacacataaccttctcttgactatcatacccctggtataagctcatgatgataccgaacaagtgatccattccagcacctttagcaacaccttgtgcttccattgcataagtctttctatctttaccacaatgcttattgtgacagtcaagaactaaaaacagagctcggtctaagtacttcagataagtcgtctcaaatgcttcaatttttctatatgaatattcatcgtcagcgtacattgctttaagatcatctgatgcaccatcaataatagtcttaaacagtttttctggattgtctaatgagctttttgtactatgaagagacacgtaccagtcagacttaattttaaaatgagaaccatctttcatcacagcaacatagccttcgatgttttctgcatttttagcttcttctacccatttaggactatcgatttcgtatcgttcaactagatacggacgaagaatagcatctttataaatatcatcgtatgaaatgtattcacccgtttcgttttcacgaacattcagtaaaataattttcatttcttggtaagcaagaacgattctattcgtcggagcaacgaattcgaagttagcagtaaatccatcttcagctaattctttaagtctatcgcgcaaccgatggtgattaatattcatcaaaatcccattagccattaaagcctgctcagatttgattgaaccctttgatttgaacagaatttcatcaccatctaaataagttgataccaaagacccgtcttcttttgttagaatgtaatcaacatcatttaaatcgatattcatcgtgaatggattttcattcaagttaaaaaacttttccataggacgagaagcgattcttaccggtttttctccatccatttcaaacataattccacgacattccagtgcatctggaagtaaccaatcagaataagatgcataattatatgagaaaattctataagttcttccagatgcacttacatcatccgagtaaaaaaacttacgctgtgaatccttacatagttccattaaattgttaaaaagttcttgcattgtgtatcctcttttgtgttttgaatatagtaccacactccatgtggaagcatcattttttcttatgttgaatattccaaggcgggttaaacagtttaatgaatagcggctcctctaggtcaatcgttgcgattgtcattgtacctaactcatttgtcatagaaagattaaaacattggcgggcgtaaaattcaactttgcttccttcctttagcgcagaatgaattaatgcagatttagtagaatcagacgttttgtctttacggttaatagcagttctataataatttattcttttacgtaaatttttagtttttccaatataaacaagctcatcatttatagcaatagcataaattacgttatacttgtttggaatagataattgttttatacttccgttgtcgtctaattctagctcagtatatttaataaatgaatattctgttgcaatttctttcataataaaatgggccttgcggcccactccttaaaagtattttttaaaactcatcataactttatcatcaacatcattatcaatctgtgcaacaagataagatgacagttctacttcttgtggcgctgattgaacattatcagaattaagatattcacgaatccaaggatatggatgtttaaccggagcatcggtaattgggcatggaagaccacactgtttcatacgagatacagttaagtaatcaataaagctccacatgctatttgtatttaatccaggaacatcgccatctttaaataaatgaactgcccaatctttttcttggcggttaacttccatgaaaatatcaactgcttcttgctcgcactcttgagcaattttaacccattcatcgccatcagtaccagattgaagttgacgaataatatattgtgtacctttaagatgaagctgctcatcacgtgcaatgaacttcataatcttggcattaccttccatgatttccatgtttttatggaagttaaaggtacacgcaaaggatacataaaaacgaatagcttctaatgcattgattacatgcaaacagaggtaaagagatttcattagctcacgcttccaatatgtctcatgctcaatagcatcttcaataacgtcttcgtctgcattaatttctttttggtattcgatatcagctttagcgttttcccaataacgagttttaatcagaacatcatcataataacgtccaatggattcagcacgtttcataatagcttcatctaatacaatttcatcaaataccttcgatggatcagtataaagatttcgcatgatatgtgtatatgaacgactgtgaatagtttcactaaaagtccatgtagcaacccatgtatcaagacttgggtctgaaattaacgacataagtacagcagatggtgcacgaccctgaatgctatccaaaagtgattgatacttcaagttgttagtaaaaatatcttgctgatattgaggaagcttgttaaattgcgcagcatccatcattaagtttacttcttcaggacgccagaaaaatgacaactgcttttcggttaaatcttcaaaaactttatgacgttgaatatcataacgcgcaataccaagacctgaaccaaaaaacataggttcttttaaaacatcaactggatttgtattaaaaactgtgctcataaattttccgcttagttaatagttagtgactcgtccgtgagtcaaattatatcataatttacaggatgaacaatcttcagcttttggagtttctatttcataatcatcagtaccagaaccatcacgggtattatgataatagaaatttttaatgccataataccatccgtatagcatatcatcaatcattattgacattggaaccttgcctttagggaagatttgggggtcataatatgtattcgctgaagctgattgacatacccatttcagcataatagctacctgcgtaagataaggtttattacctttcttagctaatttccatgtatagtcgtaaaggtctatgttatgctcaatattgggcacgacttgattaaaggagccctcttttgattctttaacagagactggtccacgtggaggctcgataccgtttgtactgttagaaacttgggaagatgactcacatggcataagtgctgataatgtgctattacggatgccaaagagcttaaggtcttcccgcagcgacgaccagtcacaaacgtattttggagctgcgatttggtcaatctttttattgtaccagtcgataggtaattcgcctcgagaccaacgagtgtctgaataatattcgcaaggtcctttttctttggcgagcttaatggatgctttaatgagtccatactgtagtctctcaaatagttcatgtgttaaatcgttagcatcttcataagaagcaaaattacttgccagccaagctgcatagttagtaacacctacgccaaggtttcgacgttttttagctttttctgcttcaggaactggatatccttggtaatccaaaagattatcaagagcacgaacttggacttctgccaattcattaattttatcttggtcttgccaatcgaagttatctaacacaaatgcagataacgtacacaatccaatttcagcatcaggactattcacatcatttgttggaatagcaatttcacaacacaagttgctctgacgaataggtgccttttcacgaataaacggagtatagttattcgtattatctatgaactgtacataaatccttgctgttcctgagcgttcagtcatgagtaattcaaacagttcacgggctttaatacgctttttacgaatattagggtctttttctgcggcttcgtataattcacggaaacggtcttggtctttaaaataagaataataaagctcgccacccatttcatgcggactgaacaaagtaatgtaatcgttctttccaaaacgttccatcatcaaatcattcagctgaacaccataatccatatgacgaatgcggttttcttctacgcctttgttatttttcaaaacgagaagattttcaacttccaaatgccaaataggataataagcagtagcagcgccgccacgaattccgccctgtgaacatgatttaacagcagtctgaaaatgtttccaaaaaggaataacaccagtatggcgtacttcacccatgccaatcttagaaccttcagcacgaatcataccaacgttaataccaattccagcacgtttggagatatattcaacaattgaagcagaagccttattaatagactttaatgaatcacctgcctcaataacaacgcatgaactaaactgccgagttggagtacgacaaccagccataataggagttggtaatgaaatctgtcgagtagatactgcttcataaaaacgaataacatgttttaatctatcaacaggttcatcttgatgcaatgccattccaatagtcataaatgcaaactgtggagtttcataaatttgaccagtggttttatctttaactaaatatttttcttttaattgcatcgccccggaataagtaaattccatatcccgctcgtgcttaatttttgattctaaaaatgtaatttcttctgctgaatattttgacaacagttcagggtcgtatttaccttcatttacacagtaagaaatatggtcaataaatgaacgcggttcatactgcccataaacatgcttacgaagagcgaacattagacaacgtgcagctacatattgataatcaggctcttcaaccgaaatagaattcgcagcggccttaatgacaatagtctgaatatcatcagttgtcattccatcacggagataagatttaatattttcatataattcataaggatctactgatgttccctcagctgcccaagataaaactttaataattttttgtgggtcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccgacatagacggcccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctagctcacttggattaggaagtgtaaaaagaactacaccagaagtatctttaaatcgtaaaatcatattgccattttccctttaattgctggatgcgattcataattttcaaggataaaatctttcggtttcatgtattcagttaaccagtaaagctgtgtttcggtgtcacaatttccaaactctataggccaatcaattttaagttcacatagttctttaggctcacgacgtaaaatttctttacattgctcagtatgattcatatagatgtgagtattaccaccagaaaatatcaaatctcctgggataagattacacatcttagccacaatatgcgtcaaggcagcgtacgaggcaatgttgaatggcaatcccaagaaaacatctacacttctttggtaccattgtaaatcaagataaccattacgcacattaaactgatagaacatatgacagggcggtaatgccatttgattgatttcagctggattccatgctgaaacgatttgacgtcgatcagttggtaattttttaatacgatcaatagtttcaactaattgatccacaccgccgaaatcacgccattgtttaccgtatataggaccaagttcaccactatgatatcctaggtctttagcctggttttcatagttatcgtcccaaatagttttaccttgaataagactaccatgtgtgcgaagacgtaaatcattaacattggtagaaccggaaataaaccatagaagctcagcaatgcatgcattccacgcaagcttcttagttgttaccgcaggaaaacctttagttaaatcccaacgtaatttagtaccgaacaaagcaattgttcctgtgcctgttcggtcatcggtttcatagccattttcaaaaatgtctttaattaaatcttggtattgtttcatttagtaccttatataaattataatacattttatgaagctaaataatcaatacggtttagcatcaaattttctctcaatttcaggcgtgaaatataattctttaccgcgtttggaaaagcgaccaataatatgataattattctcatcaaacgtgatattaccaatatccatagctttcaaccaaatatcgatatttctatccagctttatgtcaaaattccaatacggagaactattaccgaaaatactgcaagcggattcagtgaaacaactgctataaatcttgtctttaggaactactaattgatagacacctttaataaactgaggaccctgccactttggctgtttcgtgtctttttctaatagaatagggtaataattaaaattcatatttccgccacgcgttatttcatttatatactgattccgtaagggttgttacttcatctattttataccaatgcgtttcaaccatttcacgcttgcttatatcatcaagaaaacttgcatctaattgaaccgttgaattaacacgatgccttttaacaatgcgggaaacaactacttcatccgcataaggtaacgcagcatataacagagcaggcccgccaattacgcttactttagaattctgatcaagcatagtctcgaatggcgcgttatgacttgaaacttgaatttcgccaccagaaatgtaagatatatattgctcccaagtaatatagaaatgtgctaaatcgccgtctttagttacaggataatcacgcgcaaggtcacacaccacaatatgactacgaccaggaagtaatgtagataatgactggaacgttttagcacccataatcataattgtaccttcggtacgagttttaaaattctggaggtcctttttaactcgtccccatggtaaaccatcacctaaaccgaatgctaattcattaaagccttcgacggttttagttggagaataagcgaataccaatttaatcattacgcaaagcccctttcaataaaccattcagtggctttattagcgtcaaagaataattcttcatatgtcttttctttgttttcaaagactgtcacacaaacacgttgacattctccacagtattcttctgacatactcaaagcgtcagaaaacatttcattaaattcatttaaatcaggattatgcaatgcgttaaaaattgcataatcgaattcatcattcataaattcaaatacaaaaatcatattattttccttaaacagactttttcacaattttccaatcagctttaaactgatcaacatcagaatgataaatccagaatcctgcgctttctccgtcttcataaagaggacatccatcacattcatcttcccatcccatgtcacgtaaaagatgttcagctttttcaacaagttcagaatctttaccgatgatattaaaataccatttacctctaacttctgaatctttgatgctctggcgttgtaatctcattttattctccttagcaagctttaatcaaaagatataaacagaccaacataactgctgccataatataaggtgcgaacattttcttttctccattagttttgatagggtaatagtatcacactactacccttctgtaaactactttttgaaagtttttcgcaaaagttcaatgatttcatctacattgttttcgtcaacaatgcagtgaatttttgttacgccagaaactttgtctttgacttcatcttcttcagaagtcggttctttatactcacgaaaacaatgaaattcgtcttcacaaacgttaaagtaaaaatgctttccatttgcgcattcaatgtgttttattactctaaatccatcaacaaagaaagcttctttaacttcaaaccatccgccattttcttgaataattttaactattgctgaattagaacgtgggcgataattaataaatgtatcaataagtcttggaacaagttcatactttttaccgatatacattatgttttcctcattttaacggggctgtaatagccccttgataattattgttcaatcaatcccatgtaaaattctgcgtcttcagaatccataccatcacaatattcattagccataaagcgggtgaggtcttcaagaggaccttcaataacgatttgaatactccaaaacttagaatcttgcacgcttgtgatactaagttcaggataacgattacgaataatttcttcgatatattcaaaatcaacgatgtcaatatcaactttagccatattattttcctctttaatcatcagcagtattgccgatagttgtatagtaccatggaaggacaaggatgtaaaccgttttgtgaaaaaatttttgaaataaaaaggggacctctagggtccccaattaattagtaatataatctattaaaggtcattcaaaaggtcatctaggtccgtgtcatcagcactagatgaactgccagagcttgagctcataaaatcatcttcagtttttgtattgaagtcatcaacattgaatgcatccaaatcatcagcaactttatcagctttcttagcagcagttgcagcagcaccgcccatcacagcagttcccataacttgaccgaatttagtgctcagttcttcaaacgatttgaatttatctttagaagtcatttcagaaaggtcaaccatttgttcgaacagttctttctggaaagattcatcgtcaatgtttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttacaacaagaatattagcccagtaagaagttttacgtttaacaagactgtactctttattgtcagtgttgtacagatcatttttactgatgtactgacatactggacaagaatcgtaatcaccgtgggtagatgaacagttttcaatataccatttaccatttttcttgaaaccgtgatttacaagaattgcgaacggtgcttgttcatcatttttagacggaagaaaacgaattactgcttgaccgttacccgcattgtcgagtttcagtttccactcgcctttatcttcagaagaaaaaccacctttatttccagccagtttagccatttgtgcagcgagttcagcagtagatttacgtttaaacatttttatttcctttttaatttaattaacagttggtgctatgacgatgtatgacctcatagctggtcagtgagataattataatctatttataataagcaattaatacttgcaagatttcacagtttcaatgaaaacacttttagctttctgtgaatcaatatttaaaatttttctataagcctttaactttatagaataattattccagactaaattatcagtctgttcatcatgtttatcaattatatttaaaaacgaatcaagcaagataaacgtctcaaacgaaattatgttcgattgaagtagtttaaaaatataacttgattgaacttttggattatattcaaaaatttctttaaaagcagaaacttcaacttttttactaaaataataaatgttgcgaatatcttcttcaaacttaaatttaatttgctttaagcgtccgatatattcacgataaaacacaagtgcatcagcgtcagagatgtcaccaatccaagcatcctggttagcaacaagattgcttataaagattaaagcaagttcctttaatttatatttttctgataacttctggaaaaaatacttatcccttcgcttttgataagcggcatcagacacccgcatgcaccaattatacttaattacatcatactttccattcatatgttgttttatcattaagtataatttataaactgatttaccatcaatgtatctttcaccaccagcaggcatgcggagtttaatcatagtagaaaatctaatgtattagttttttcacaacgaacaacagaaggacgtaaaagattttcgtcaatggcttctgactgaattttttcaattatacccgaaggaataaatttagcaaattgagtttcaggaatagagttttcttctaagaatgctgttgtagcttcaagataactcattccaaactcttctaccattttttcaataataaatccattttcttgacgatcaagaagctttgctatttcatccttttctttcttgattgaaagttctttttctgaaagaccggtctcatcgaccggacgaatgtcatttagagaaaactgtgtcataaagttcaactacctcttcagtttcagcttcaaacacatcacggttatctttatgatacaaagctaatagacgattaaacatcttaccatcaacgccaagttcatctttggcacgaattcgaatatctttaatcagttcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacgattgaagttttcattgaaggagttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttatgcatcggtgaccattgcttaacatttggatatttgtgaagctgtgtaaagtcaccatccgatgaaatgattaaaatcttatgtccttctaaagagaactttttaacaagaacagcaatgtggtcatctgcttcatacttatcaatatccataacaatgtatggcatataagctttcaattcatctataactttatggctggattcaaaataaccttcccagtcccaagtagattcttctcgtgcttttccacggtttttcttgtaatagtaagcgaaatcacgacgccagtatccagatttcgcgttatcaatacatagtacaattttagtgtatccaagcgtttttgcttttttgacattaaacttaattgagttcaatatcaaatgacgaaccatcgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgaccgtaccgtaggaactgacggtgttaacgttgattacttaattcaagaaaacacagttcagcaatatgatccaactcgtggatatttaaaagattttgtaatcatttataataatcgtttttgggcagcaacggataatattccaaaacctgctggaaattttaatagaattcgttggaaagcattacgtactgatgccgtatatacaaccgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatgatattcatttttaataatcgtttgtggcaaatgtatgttgctgattatagcagagaagctgcgattgttactccatcgactgcgtatcaagcacaatctaatgattttatcgtacgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaaggccgtacatcgattgacggtttcttgatgtttgacgataatgagaaattgtggagattgtttgacggggatagtaaagcacgtttacgcattataacaactaattcaaatattcgtccaaatgaagaagtcatggtatttggcgcgaataatggaacaacccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaatggtgaaactaattatgtaccagttttgcaacttgcttatatagaagattctgatggaaaatactgggttgtacagcaaaacgttccaacagttgaaagagtcgattctttaaataattctactagagcaagattaggcgtaattgctttagctacacaagctcaagcaaatgctgatttagaaaattctccacaaaaagaattagcaattactccagaaacgttagctaatcgtactgctactgaaactcgcagaggtattgcaagaatagcaactactgctcaagtaaatcagaacactacattctcttttgcagatgaccttatcatcactcctaaaaagctgaatgaaagaactgctacagaaactcgcagaggtgttgctgaaattgctacgcagcaggaaactaatacaggtatcgatgatactacaatcatcactcctaaaaagcttcaagctcgtcaaggttctgaatcattatctggtattgtaacttttgtatctaccgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacgccagaaacgttacataaaaagacatcaactgatgcaagaattggtttaattgaaattgctacacaaagtgaagttaatacaggaactgattatactcgtgcagtcactcctaaaactttaaatgaccgtagagcaactgaaagtttaagtggtatagctgaaattgctacacaggttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttaataactcctaaaaagcttttaggtactaaatctaccgaatcgcaagaaggtgttattaaagttgcaactcagtctgaaactgtgactggaacgtcagcaaatactgctgtatctccaaaaaatttaaaatggattgtgcagagtgaaccaacttgggcagcaactactctgataagagggtttgttaaaacttcttctggttcattaacgtttgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgggtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattaacggaaattatggtttcattgttcgcaatgatggatcagtaacgaattttatgcttactgcatcgggtgatcagactggtggatttaatggattacgtcctttagctattaataatgcatctggccaagtaacgattggtgaaagcttaatcattgccaaaggtgctactataaattcaggcggtttgactgttaactcgagaattcgttctcagggcactaaaacatctgatttatacacccgcgctccaacatctgatactgtaggattctggtcaattgatattaacgattcagccacttataaccagttcccgggttattttaaaatggttgaaaaaactaatgaagtgactgggcttccatacttagaacgtggcgaagaagttaaatctcctggtacattgactcagtttggtaacacacttgattcgctttaccaagattggattacttatccaacgaccccagaagcacgtaccactcgctggacgcgtacatggcagaaaactaaaaattcttggtcaagttttgttcaggtatttgatggaggtaaccctcctcaaccttcggatataggagcaatcccatctgataatggaataataggtaatcttactattcgtgatttcttacgaattggtaatgttcgcattattcctgacccagtgaataaaactgttaaatttgaatgggttgaataagaggtattatggaaaaatttatggcagagtttggacaaggatacgtccaaacgccatttttatcggaaagtaattcagtaagatacaaaataagcatagcgggttcttgcccgctttctactgcggggccatatgttaaatttcaggataatcccgttggaaatcaaacatttagtgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagtaggaacttcagtttttccatcagattcagtattgtcaagatttgacgtatcatatgctgctttttatacttcttctaaaagagctattgcattagagcatgttaaactaagtaatagaaaaagcacagatgattatcaaactattttagatgttgtatttgatagtttagaagacgtcggagctacgggatttcctaaaagaacatatgaaagtgtcgagcaatttatgtcagcggttggtggaactaacaacgaaattgcgcgattgccaacttcagctgctataagtaaactatctgattataatttaattcctggtgatgttctttatcttaaagcacagttatatgctgatgctgatttacttgatcttggaactgcaaatatatctattcgtttttatgatgcatcaaatggatatatttcctcgacccaagctgagtttactgggcaagctgggtcttgggaattaaaagaagactatgtagttgttccagaaaacgccgtaggatttacgatatatgcacaaagaactgctcaagcaggtcaaggcggcatgagaaatttaagtttttctgaagtatcaagaaatggcggcatttcaaaacctgccgaatttggcgtcaacggtattcgcgttaattatgtctgtgaatcggcttcacctccagatataatggtacttcctacacaagcctcttctaaaactggcaaagtgtttgggcaggaatttagagaagtttaaactgagggagccttcgggttccctttttctttataaataatattaaaataaaggggcatataatggctgatttaaaagtaggttcaactgtaggtggatctgtcatttggcatcaaggaaattttccattgaattcagccggtgacgatgtactctacaaatcatttaaaatatattcagaatataataaacctcaggcagctgataacgatttcgtttctaaagctaatggcggtacttacgccggtccaattactattaattacggggtaaatagttatcttcaattaagtaataatgaaacccctatccgaattcgttctggtggcggcactggtaatactcttgtagttggcggctcttccggtggtattagttttagacctgcaggtagtgaaatcactactggacaaattactattacgccagaaggtttgacaacatttaccagggctgtaacggctccatcggtaactgttacatctactccttccgcagcatctgatgttactcgcaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaactgcaggtcaacgtcctgctgcttcagtattagccgaaggtgaattggctataaacttaaaagataaaacaattttcacaaaagatgactcaggtagtgttatagaattaggtttaaaatatggaggaactataaatgggtctttagaggttacagaaaatataactggaactttaattggaaattctagcacagctactaaattgcaaacacctaggaaaattaatggtatatcttttgatgggtcaaaggacattaccttaactccatctgacataaatgtcaatagcacaacatttataaaaaataatggcgaattacctactgatgctaatttagatacgtatgggcccattgaagaatatcttggtgtttggtcgaaatctacttcaacaaatgcgcaaccagcaaataaattcccagaagaaaatgccgtaggtgtactagaagtgtttgtggccggccaatttgctggcactcagcgttatactgtaagatctggtaacgtctatattcgttccttatctgctaaatggaatggcgtcgatggtccatggggtgtgtggcgtaatgttcaagcgtcaactcgtccactttcacaaacgattgaccttgatagcttgggagaattagaacattgtggcttatggcgaaacagttcaagcgcaatcgcatcatttgatcgccattatccagaagaaggatcagccgcacaaggatttttagaaatatttgaaggtggtttatacgcgagaactcagcgttatactacccgcatgggtatggtttatactcgttgtctcgctgctgcatgggatgctagtgcacctaagtgggaggaatggaagcaggttggtcatggcacaccagcgactttctatgatggagatctgaatgattttaaaactcccgggttatataatattttaggcactgatgccgttattaactgtcctacaggtgaaggtttgccgactgttattgttggtttgctggaagttaaacagcgtgcttctggcggtgctattttccaacgtttcactaccgcaggaacgggtgcaactactcgcgatcgtatttttgagcgtgcatatactggtggtgcgtggggtgcatggaacgaagtatatacatcttattctctgccaattactttgggtatgggtggtattaaagctcaattagcggagttagattggcaaacctttgattttgtccctggtagtatgtttagtgttcctttgaacaaaataaagaatatgccagcaaatatggattggggcacgattgatggaaacctggttatgttttccgttggtcctagcgaacacactagcacaggacgtactgttcagatttggcgcggtactgtatcccagacaaactaccgttattttgtcgttcgtgtgttcggtaattctggaaatagaacttgcacagtccgccgtgttgttcttgaagatggtcgccacacatggacagctcaacaagattttaatggcgcagttaactttaactctactgttaaccttaataacactacaacttttaacacagaagttaaattccgttcatccaatgcatttaaaatgtatggcggtaattttggcacaattttccgtaatgatggtgaaagtctttatattctttccaccgacgaaaatgatcaagatggaaactttaatacaaatagacctttccgctatcaattaaaaactggcgatgttactttgggtggcactagcggtgctaacgctttagtattaaaaggcggttctcttgctgctacctttagcggtgatgttaatttaagtaaaggtacgctgacgtttgaagcgggtggtaagcaatcacgcgattatttccggtttaatcattggggtgatagtaataatgctcgtgataatatcatccagttagaagacagcaaaggcgctcatttttccactgaacgtactttagcgactggtgcaattaagactaaattttttggtgaaattgaatccgatggtaaattggttattaaacgtccgggtgattctattgtattatcaacaactgctagtaattctttgcatattcgcggtgatatagacgggactggtaactggtatattggtaaaggtggtgctgataatggattagcgttctatagttatgctactaatgctggtgtatacattacaaacgcaggagatatctcgctaagtccaaagggtgccgaaatggctcaggtcaataacgttcgattatatgttcatggtgaacgttggaccgctagtcaaccaggtgattggggcagtcagtggcaagtggaagcgccaatattcgtcgatcatggttatgttggaccagatagctattatccaattattaaaggaagaagtgtagtcaccaatcaagggtttgtaactgccgtcgatcttggtattcgtcgtgtccctaacaattgggggcaagcaattattcgtgttggatctgcagaggcatcgccagcggctggacaccctaacgcggtatttgaatttcattacgacggtactttctattctcctggtaatggtaactttaacgatgtgtatattcgttccgatggtcgtcttaagattaataaaaaagagctagaaaacggagcacttgaaaaagtatgtcgactgaaagtttatacatacgataaggttaagtctattaaagatcgtagtgttattaaacgtgaagttggtattattgctcaggatcttgaaaaagaattatcagaagctgtatctaaagttgaagttgatggatctgatgttctgacaatttctaactccgctgtaaatgctcttttaattaaggctatccaagaaatgagcgaagaaattaaagaattgaaaacgcctttcttcactaaaattgctcgcaaaattggtaaatactttaaattctaataacaaggggcattgcccctttggagataaattatggcagtagttggtgttcctggttggattggaagttcatccgtaaatgaaacagggcaacgatggatgagtcaagcggctggtcaattaagattgggtgttccttgctggatgagtcaatttgcaggtcgctcgcgagaaattattcacacgcttggagcagaccataacttcaatggtcaatggttccgagatagatgttttgaggcaggtagtgcacctatagtgtttaatattacaggtgatttagtatcatattctaaagatgttcctttattcttcatgtacggggatacgcctaatgaatatgttgttcttaatattcatggcggtgttcatatgtggggtcgtggtggtaatggtggatacactcactcaggaggcgacggtaacggtacacaaggcggtcatgttattcaaaatgatatcggtggacggcttcgtatttggaactacggtgttatagctgctggcggtggcggcggtggtggtattgcatatcgtccacactcaggggcaaactggcaagatatcggtggcggtggtggtcgacctttcggtgccgcgggcggtggcggttattccggtggtgctgcttcgtatgaaggtccgggtggtggttatgactatggtaacgcacactccggcgcaggtggtaatgctggtgctgctggtcagaatgcatggtctgacggcggtaaagttcttaaagttggtgttggtggtgcgtctggtcatgcagtgtttgggtcttctccaacttggggtgctgttggaacaatttacggaccaagagtataatttgaataaatatccttaaaaggagggtctatggcagcacctagaatatcattttcgccctctgatattctgtttggtgttctagatcgcttgttcaaagataacgctaccgggaaggttcttgcttcccgagtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacgataaccatgtactggtatagaaatgatcatataagtaatgaccgccttgaatcaatatgtgctcaggcggccagaatattaggaagggctaaataattatttgttcgtatacatttctagatatcgatatacaccctcaaaaccctcgttgaattcgtcgatgagggttttcttatcttcttgagttaattcagaaacaattttacggaatgaattctgatttaactttctaccttcatgtgttactccaatctcattcagaaatgcaataaaattagcacgattttcaacaatatcttctctggaaaatttaatcaaaatagacgcaacagtaataatttcacgaactgtatcaatgtttttattcattaactataccactcaattagttgactttgttataatatcatcagacgcttgatttgtaaactggtctgtgttattttcttcaaaaattttttctacgaattccttgaacgactcgcgttcctgagctacattatgctcgattaccatttcaagattatgactcattcgaaataatcttcaatttcgtaatcatggacataaatcattatagtttttaatacatcatcaatactttttcctggagctggaattacgtaaaaatatcctgcttttgagaggtctttataagttccaaccaagaaatcattattctcgagatgtaattcttcaactaattcattaacaattgaatggtataaatttggtagaaacttatatagcttttctagaatatcaattttgattgtatattgaaccacagattgagaatcaataatcatagaccttccccttatgtttctgtttgcgattagattctttaaacgctttcttcttatccttatgaacagaagctttattaaaattatgttttgcgactaaattgttcatagtgctgaattacctctcttaaacatttgcatgtgaatgaaaactttttagctacaccacattcaaatatatgttctcttaaatcacgtgtatcagtatatcccatctcaacaataaaatgccgtattagatttttatctttatcattgagagagttaaaataatctgattttgaattaatttccctggccaaattgaatcaccttcagttgacgttttagctcttttatcatttcttcgttcatcgcaatataaagatcgcgtaaagcaggttttagcattccatttaccggagaactaaatgggcatacataatcttttcctacaagctttttagtgaattccatatcacagaactgaaatgccggttcattcgcataaattccccaattagttgacatcattttattggcatattccaatgccttaatttgattcgtaattccatcaatttgaaactttttaatattcattagtaaaggtcctcagagtaaagttctttttcactaccaccacgttcaatacgcacttgtccagcgtaagttgcaataatcattgcttcttcacgtgtccagtaattgctatactggtcaataaatccttggtcttcaccacaaacatggtctgatacaagtttatcacttacctggtcaagaacttcagccatatctttagaataatgacgagcaccaggaataaccagagtcccaccatcttttaacttaaagcggttggctgcacacacaattcgacgttgatatttttcattattgttccaatgagctacttgccaacagatttcaggaacctcttctaaaacatcctcttccgtatattcggtgtagtcgccataggcctgtaatttagctgctagactttctggagtttcacgtaataaagccaggtctaataattcaagacgctctttgaaggttttcatttggtttcctcaacacttttaatttttatagcttgtttagaactttcaaagcattgacaatatactcttaccgcatcaaactggttggccgctttaagatggactacaccttcgtcgttataaaattctacgacaattttaaatgttttcatttaaaccatcctttaatacgttgccataaagttttctgttgagctttgttaacaccaattgaacgaataactggttgagattcctgaaattctttataatcagcaaggtaaatttcgtaagctgcatccgtaaatgaacttatcgctgccataaaattattgcgaatacctactggagcatctttactttcacgaataatcatgtatttaccagtcttaatctttacgatagttccaagataagctccatggtaccagatgtcccaaccctcttgagtaggttctgcacaacgacgaagttcattgacaatttctaacttgttcattatttattcctcacagttcagatgctacagtgattacagcttcaatgttttctgccgagcgtttaatgtcaagatacacattaccgtttttagcgattttacatgacattccgatatcagtaaatttctgaatatgatgttccatcattttgtatccaaaaattcgcatatttccattgttgttaatttcaaaattacgaattccgtgagtgcgtttttctaaaatggcaagataattactacgataagtttcaacctttttaagaacaaatccattttcatctaaaagttttaacatgaggtctttatcttcttccatatcagaagtaatctcacgagctttacgagttgctcgttttttcagtagttccggagcattttcctgcgcgtataaagttgctgcgtttgaaataatatcttgagcttcaccagtaatgattaatccatcaccagatttctccaccaggccttttttaatcaataccccaatattactattaactactgcgttacctaaatctggatgcacctcacgaacttctgcggctgtaatgaaatctttcttagcaatggtaattaaaatcgcagcagttttttcattcagaacatcgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcattttttgtatctccgggttgtttgtttcagttcatttatttgatagttgtatagtaccacagtatgctttggttgtaaaccgttttgtgaaaaaaatttttgaaataaaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagcttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatggcgttcttcttcattatcgctcaaagagtattcttttcggaatttaactttgaatccaaaaccatgctcaccacaagcatcatcccatgtaatgaagcctttatcttcaagcgggtctaagattttactcacataagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgcagtacagctttcttgacagaagaaacactatgaggaagaatgtaagttgcataaccagttgcaataccggaaacgccattaagaagaacagtaggaataataggcaaatagaaagcaggcggaatgtgttctttatcttgatgtactggagcatattcagtatctttatatacgttatagaaatttttacttacacgagcaaaaatataacgacttgctgctgccttttggacagtacgagaaccaaagtttccttgaccgtctaacagaggaaagttattattccaagtgttagccatcaaagcacctgcgtcttgcgcagagttttcaccatgatgatatccaaggtccgctacaccgcctgcgatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcacgattattcagttgcataaatttaccatactagtgaatgtagtgccataataacatcagaaatgaaaagcacgacttgaattaatccgaacattattccgtaatataatgctatcaataaaatagcaagggctaatgaatagcccaagattttcttaatcattagtagataacaacacaaatgttaaatatgcacacataccctgagctaaagcttgcgaaaacacactgctgacatcaatacagatagttaaaacacatgctactatccaacaaataaatgaaataactcctaataattttgcgatattcatattttcctcactggcgtccgaagacgcctttagttttaagattattacgatagaactgcatcacgtgttcgttgtggaaattactcattaatatgcctgcaaaacgaatttaaaattatcagccaacatacggttcatttcttcaagtgtttgatactcagaatgatgattacgagtaaacgctaaagctaactgtccttttccaaatcccgtcgtcagaggtttcatcttagaagcaggcagataaaatactgtgtataccatattgttatttgcaatagtacgtgcaagctgagaccgacgttgacgaatatgacttagaactgcactgaatccttgcttagaacgctgattacctacataaaatcgtgcagacacacatggattactaaatggacgaccatctaatttacttactaaaaaataaaatccaggtttagataaaatatctttatgcggagttcccaaaaaccactcaccacccttgattgtaccaataacagtagcgcctgcattattcagatcagtaacagtcatgtatttcatattaatttcctctaaattattttctactccaaggccgcatgaatacacgcggccattaaattaatcgtcgcagtcgacgctcaattcccaaaactcttctacggtataagtttcagtatcattttcaatacagaaacgttcattactgttatttgctaaagtagcgttaactgtcattttctcgctggtgctcttaagaggtgaaatacgaattaactgatcaccactatccaagcaaaaaatttcaccaacttttacatctttaaagattttcataattcacctcaaggagtataaaatccaaatgcagttgttgaccatcccatccaatatggaaaatttgcgccaatgtaaaacataagaatataaaaccaaccactcagcaaattcatcattttacaccattccaaattgtttcaaccacggattttaaaccattttgatgaatatccattccgactaccgtcatcaaataaattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaagcgtttaatacatcaatcattaaaacgattgggaatatactcaaaactattagtattataactacattccatatagctttaacaatctttttcattttctgttcctccgtagttgatagggtaataataccacagaggaacggtcttgtaaacaacttttttaaaaatattcgtaataaatgtgaataccaactactactgctgaaacttgcgcaacccaccacgcacaagcaataagcacagaattcaaaattttcataataacctcatcacaaaagtaaatgttaaacaaattaatggaatactaattaaccaaacgaaacaccaccataatgaactcatagttcaatctcaacgatttccaagtgtttttgttttattgcctttttaacacaatcatggactaaatatgaccatgaatcattatattctccattaactaatcgttggagatcttcacgtgatgataagtaaggttgatctgattcccattttgataaaaatactgcagtaaaaatatctccttcatctgtagttgaagtcgtaaatgcaataaattcaccggtaattttatgtttagcgtaataaaatttaaatttcatttttactcctccgtagctgatagttgtatagtaccacagtccttgtggtatgtaaaccgttttgtgaaaatttttaaatggaaagataccatccattgtagttgctttttcttacaaccttacgaaggtcttctctgtcaccgatgaacttcggagtgtattggatgacacctggatgaatttctttagtgttgaatataattatacagtcagcgactcgatgatttagaatgggccctagatttattccagaaccgtatggatactctccgctgcatccggttgttaccgaaatccaacgtgagtcagtttgatgtgttttgacttctacacgaagcccgcagtattttggatgtgctaaaacatcccatgcatatgtatacggatcatcgacatcttcttgacctttgttaacatatccactcaaccaatctgctaccacatactcggcatacacagcaatacggcatctttcgataacttctgccttatcctgatttgggttttgttttaaagagtatcttgcagtatcagcaattttgaccttcatttcagtagtcaagtcactgttcgatagagtaaatgtcggaatctgaaatagtctctgcaaacccggattcgttttctgcatttaaactttcctttatgtcggaatcataatttctcttaaaacaaaagggccgaagccctttattttacttgaattgtgcaattcttttctctagacattcagcataagatttcattgagatgaactgcgaaagcagcagttcttgctcaactgcactaaccgttagaaactttgtgctttctaaaaatttgctcagtgcattaattttgagcattaattgatcgtattcttcttttactcgtgcttgataacctaacataaatttcctttagtcaaggaccgaagcccttatttaaattgttcagtaacgtcttcaattacttcatactggcaggtacgcattttagcatcgttgtaatcaatcggaattgatactacatcacgcggatgtactttaacttttacaactcggctagttgaactgccaaagtgacgaatataagatttagaacacacatgcagaccgcgagaacaagtttgtgtatcatcgtcattcacacgagtacgtggcattttaactactttaccaggactgttatcaaaggtatttgagtgacaatcaaagtaattgctacgaactactttccaagcatagaagtaaccatcttctgtaatttcaatatcgtttgctaccaagaaatcaaagagtcgagataccgctttctggcttgggttttccagcagattttccaagaacggaaaataaaattcaaagttttcgcctttttccatcgaatcaagaatacgatcaaccaaaccagaccgcaattcaatattttgatagaataagcttccaccttcaattcgaacatcgccggaaatatatttttcaacagcgcgacgaacattaattttttgtgctgcttcttctaacttatctgctacgagcagattaagaatttcctggaagtttgaatgagtattaggtgttgcattataagttacaccatcaacagtaatcgaaatgaattttttagatgcattccaaataatgtcagatttagcaactggagcaataactgcatcgctattaactttaactgtaatatcaccgctaatagtaactttagggcgtttagcttcttcagcatttttcaaaacacgacggattgtgtcaaccgatacaccttgccaatcagccaattcctgctgagtgtaattaccacttgaatacagtttaacaatttcagcttgttcgtttttggtcaggcatttaatattgtacataattttcctta

SEQ ID NO: 2 - DNA, 167876 bp, Artificial sequence
  Synthetic polynucleotide
  misc_feature: Ec34, E. coli bacteriophage
ttaggccgcaagggccttcatagttttagcgatttgggaaacttcatcatcacttaaagagttgcgatatccgatgaagtcggaaacaatacggaatttcttggtaaactcagcaaccattttatcactgttttttgaagcattatttgataatacatcaaaaagattagttactgtccagatgtcatgaccgatggtatcttttccaccattaaaatatacaccgcgcaatgaactaactatattagcgagtcgtgtatattcttcagaaacttcatctgtactgaagtacttcatcataaaatctagttcaggatacttgataattttatcaatatatcgttgagctgaacttgaataacctacgtacttatcataatctacatcatcaaaagcatctacatataaatcacgcagagtttcaaaaatacattggcactgaccgagttcttttacctttttctgcaaaagcggacgaataacataaaactcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcttctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagtaaatcaatctgcgattctacttctggattaataaacagaagacgctcattatgatgaatattcaaagtgttattaaattcactatcatctaacgcatgtgctaatccacgaacaatattaacacgatttttaatattatcaataacgatattaatttttgttgtattaataccaaacagacgataacttgatgcaacggctgaagtttcatgactttgcttaatgcgcttcagtcgagggtcaagatttacttcatacacaactcctgcattgcataacttactatcaggttcaaacatgctttgcatcttcttatatgacagatttttagtcgtaaatttgactgaattactaatcatataatctcgagcagaataccccatcttcatcaattcacgatatgtatgacggggagatgtggattctttaaatcgttttacatcttcattaaatgctttctcactgagttctttaactcgttcaataatatttttacgagtacgatcatccagtgaaagagcctcgcgagatggagcaatatcaagtgaacccattggaaacttaatgtaattcacttcattgcgaatgcttagccagttacggtctctaataacaccatcgataggataaacaataccgccatagatagcatataatccaccacgatcaggccagtatctttctggatttacaccgtaatagtcatcaaaatccggaaaataatcaatttcgcggtcaagaccattaatgatagccaaatctttgaatggtcgcatgatataagaaacttcataagcaaagtttctaaagtctttttcttcaactggaactacgatttcaataccagttttatcatctggacccatttcttttacgaatgtaggtttaatctgtggaccatcaccatccatgtaagctacataaccacgaatttcacctttatgatacgaagtaatactaaatgtattagtataactaaacggagatttagaacctaaaccaaacccgccaataaagtcattagattcagccttagatgaactgaagtatgaattatataacccaggagaattatcatcaccctgaatatcaaaatcactcatacccggaccaaaatctcgacaaacaaatcgcggatctaatcgtcctggaacttgtatgataaatttttcaggatttccattaagtgcatgggcatcaatcatattagtaattaattcacggactactgcacgaatcttgtttgtatacaaatcagatgacagaattttaaatactttaggagatgctgtgatgctaaatgcttttgatttagaaccattgccaagaattgtttctttttcagtggtgataatcataatttcctcattaattcatattacgcttaataacttcagcaacttctagtaattcatctttagttgcagtgtcggattgaattttatctctaatatctttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactggattttgaatcatctcacgatattcagatttttccaaagagccaagtcctttaatataacggatgctatgtttaggtagagcatctttagcactctcatattcagcgactgtataaaaccattcttgttttttaccaatctgtgcgatgattacaggagttttgacaaagcgaattcgtccttgctcaaacagttctggccaattactaaaaaatccaagcagagaaggataaatgcttcctagaccatcatggtcagcatcagtcataatagcaatattatgataattcaagttttcagctttttcaccgagaactaatccagtgattgcgcaaatatcaaacagttctttgtttttaagcatgtcagcatatgacataccccaactgttgagaactttaccacgtaatggataaccaccgtgaagttctttatcacgaacatcaataagatatccgatagccgaatcaccctcagtcaagaaaagagtagtatcagcatctttaccacaaagattcgctttaatatgtttatgaaccttagctttagaagcctttttagctgctttagtttctgctgctttttctgccgctaatttacgagccaaagcagcttcaataatcggcattagaattgcttcattatttagaatagcacgtgaaatctttttagcatcaagttgaatatgactacggatttcaccaaatggagaagtcaaacgctctttagtttgagaatcaaatcgcatgtttttcatatcacggacaaacataacgatagtcaaacattctttaacgcgtgctttagtcacatcaattttgaacttacgtttgatttgtggaataaggtcttcacaaatatcatccataacacagtcaatgtgatggccaccattcttagtgtgaatgttattcacataagttaattgacgaaaaccatccggtgaacgaccaaccgcaatagagcaattttcttgttcttgaacgatagcatgctcatcatattggcgtgcatatttcttaaaattgccctgaacctttttaccattaaaggtaaattgaatatcaggataaactactgcaagtgtctggagacgatctagtgtaatgtcaagataaacttgggacagctcattagtttcaaatgacataaaatcaggaatgaaagtaacgcgagttcctttccattttcctggaatagtttcccatgatttattttccatgccatttgaacaacgaactacaatattattttgaccatcaccagtttcaccgacaaacatcacagaaaaaatgtttgtcaaactagaaccaacaccattcataccaccggtgacgcgttctttatcatcaccaaagttaccacctgcttttggaatagtccacgcagcaactggaccaggaatttcttcaccggtaggtgttttgaccatcgcttgtggaataccacgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacgaatagtcgaatccttgaagaatagtccagaacatactgttccttctactttctgcccagtaggtccaatagcacgaaatccagtatgctggaaatcattttcagagcaaccgaaccaattatatccagtgatttcaatattagtaaaaccacttgaagacaaaactttggttgcattatcagcatcagtacatcctattaaagacactgctaatactaatgctgcgatagaacgattaatatatttcataattttcacttaaatttaatggcttgaagaagactaataattctcaagcgacttccttcatctttaactgtaaaagaaagagggtcaccagatttcatagtgatagtgcattcaaaagcaaaaccttcgggaacttcttcgaagaagtcaaattcttcatcataaattagaacattactctgaaaactgtgaagaatttttccgtcatttccagatgctgtactaatcattgtaacattattacctttcatatcttcaacgataaattcgcttgtagatattacagcattaatagaaccattcctataaatagcagaaaatagatatttcttttcttcaccttcgcgaatgcgatatttcttaccgattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccatgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtaccatcttcagtgatttcacgaaatacaccgtaaattggttgtttatccccaaccttttcatacacataaaccgaagtcaagtgagtaaacttagcagtgtgttccttttgaactactaccaaatctggatcgaataacacatcttcaaattcgtcattagtgcagttctgaacaattttacgtttcattacaatttcctcgttaattgaacattggagcgatgcgtttcagaagagtagcagcacctttggcaaattttccattttattctccaaattattttctatatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttctacccattgatcagtaatgtatgcacacatagcgcgagtacgccgaggaagtggttgtccaccttcgataaattcaaactcataaggagcaatgaacttaatagcttgaccgagtttccacttaaagtctacacctacatgcgaagtatcaatcgtttcaattcctttagcgggaacagctttcaaaaacgcagattcaagaaatttcgcgcgaacataaccaaactgaggtttagactttccatctttaggaatgatacgcacttttacttcagaatcttcatctttaacgccgtgtttaagctgaatgcttacaatttcgaccaattttcctgctgctttagaacgggatttatcagatacacgagcaatttcaccaatattaataatcatagttatctctcacttgttaaaaagattttatactccacaggaccattatactctggtcccaagagtttgtaaactattaattcaaaatagctaccaccgcactacgaggtactacactaaaatctcctgcatggacaacgttcagaagctcaacaccatcttcaatccactggtctgttacccaaccacagataggattatcaaaaggacgacggatagacacagcagcacacaataggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcatagtaggttccttaatttccagtggtttaacagggcatacataagtgcttacaacatcaaaatcaatcagtttagctaccggatttggtatgtattcaggattataattaaatttcataattatctcatttcaataaaatctacgagttcagcatgcgatttgcggaacattacttggtacccaccaatgataacttcatcttcaggaacttcgtatacagcgagataaaatcctttagaagctaattcttcacgctcttctcgtgtgaaccatctcatcatatcatattcactagcgaaagcaaaatgataaagacctataaaccatcctggaatatgatattctactccaacataatctttcttgaacttagtattaattactatattagcgtttttaactaatagtttatcttcgtgtggtaaaggaattcttttattattattatcgctatgatgcataaaattaggtctatcataacctacgtgtaataaccactcttcgctccatgaatctattatactcctgtatggcgttatttgaacacaaagatttcgacgtattgttatagcatcttcacaattaagaatactaaaagatgattcaacacgataaattttcattttattatcctcagtagctatgatgttataataccacaactaaccgaggaagtaaacaactttttatcgttttgttggaagagacagaggatcgcactcttcctctgacggagcatcttcaagacccatagcatatcgcaaagcatacttcatcatcaggatgtctttcgcacaatcatgaatagaatcatgtgcaacgaatccatctaaagttccctttggaagaggacatgtagtcatatcacgaacaagcagaagtgcttcaattctggtacgaatatcacgctgattccagaatttacaaggttctaacttaaatgtatcaagctcattctcggaaacgccgttaagacgttgaatatcacgaatgagatcaactaaaattggaaaatcaaacgacattccacggcaccagccttgagatttccaaggatcgatgttatgtgcattgatgtaatcattaaattttgcaataccatcgatagtgcttacatcttcatctgatggtgcaatattttttcgagcttcaggagattgatttttccaccattcgatagtgcttttagtaaaaagacgatgtcctttttggctttttaaatcaaacttgattttaatgccacgtgaaactaattcatcgaatgtttcaacgacttctggattagggtcaaaagcaattacagccaaatcaataacagctgccttttcaccacttcccattgtttcaaaatctataataaaatcaaacattaaactttcctcgctaaatcgcgaatttgacctacagcataatcttgaatataaactttattaataggttcattaataaattttgccatagattcaatatctttttgcatctcttcaagactgtatattatctttaaagctttttcgcgaatagtaatattttcaggacccgaatttttctcaatgacagctttaacatttgtcataagagatttaaactgacaccaacttaattcaatcattaataaccgccttataaagatggctaatttcacctaaaatgtaatcactgattgtaacagttttcacttcaccacaaaagaattctaacgcaattaaatctcgttcaatttcttccaattgaagcattaacttgcctgattcagttttcacatttttgcgatttttgctataagctatttcataaatttcgcttactttatcttgaagaagataaaactgatctttagttatttccacgaatagcttcctcaaatttaatcatacataaaatacatcataacgaccacgggtgacaccaacataaagaagttgttgagccaattcagcatctgcataatgaatacaaggcgtataaatgaaagcacggtctacagacataccctgagctttatggaatgttgatgcaggaagtgctttcactttactaaactgtgatttagcatcccaaaaatcactccacggagcttttccacctttattccaatttttataagtttctgctgttttacctaaaaataggttaaacttatatagctcttcatcagatgaaattattttaatcttttcacgatagtattcatcatcgccgtaagtttctactgttaaatcccaatgacgaattaagtattctccagaaacaccacgagctttaacaaaggttgatgtatactctgcttctataatacgaactaattgtccattattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctaatgattttacgattgaaaaataatttaccataaaatcgcgtaaagcggtatcaccagtaaatccacgtactccatgcccgtcaacaactttatcataaatccacttaccgttacgaacgtcagtagctacatcaataataggagcattactgcgtttaacttcagtgagttcacactgataaaaatctttatgtgtaaagaatggactgatataagcagtattttctcctggatcaacaggtctaatttgcttattatcacctattccaattatagtacaccaaggtggaatagttgaaagcagaattttaaatagctttctatcatacattgacacttcgtcgcagattaataccctgcatttagctaaatctggtacttccttctgttcaaaaagaacgttttcttcatacgtaactgggttaattttaagaatactgtgaatagtactcgcttctttccccgacagttttgaaagaatctttttagctgcatgtgtaggagctgctaaaataataccagtttcacccgtagatattaaagcttcaatgatgaacttagtaagagtagtcttaccagtaccagcaggtccattaatagttacatgatgtttcttttctttaatagccctcataacgatgttaaaggcatttttctggccttctgtcaaatcatcaaatgtcatcggaaagtccctgcaattggaatactaacaatacgcccagtatctagaattcgttgatataatctttgtgtatctacatcaggcttaacatgtttaacttctattttattaaaccaaaacttgcgtggagtctcaactagtcttggaattcccatacctaaagctagtttatattggtctttgagagtagtaaaaactctatcagcaatctctctttcaaaaaacacagcaggacgatgttcatcaagtggaactggcgccgtaaatccgtctttgtctcggtaaactatcgcatatacataaaccatattatcctcggataagtttaaaaattgaacaatttagcgggtatcctcttttcagtttaagtttatcaataaaagacaagttttgataccgctctacaccttgaataattttatcacacatatcatattgcatttctgcttctgacaactttttcacaattttccaatccgagcctttaagaagaacgttcaatttaacaacttcagcgccttctgctatgcgagaaccatcaatacgtgctttaagtgctataatccttagcttaatgtcagaggtctgttttgatttagaaagctgagaaatgtgctcaattcggttttcacgttttttctgtatagctttaatttgattataagtctttttgattttagcccatttcttttcatctaaatttagtttatgaacttttttcgcagatgaacgaccaattcgcaaagcaaataaatcccgtttttcaatcaactcttctaaagtataatcagaacgaaatgtattatactttttctttactgcaataacattccctttaatgtatccaacgttattatcaaaacgttctaatgataatttctctccttcaatacgattatcaaaaggttctcccgagtaagcgcaaactttttgatctaaaatgttcttaatgtaattgaagtctaagttaaaatctttagaacgtctttttgcagatgcctgagtatgctctagacgacgtttaattttacgaatttggttattagacagcttcatatttttctcacatcttacggacggttaactacttatactataacatttttacttcaaattgtaaacaactttatgtaaaaatgctttaaaaatttcatggtataatgaatctaagtccttccattatagattaaatccttcaaaatcaagagtatagatagtatatgttgaatactttttgtactcatatctatctgcaattctaaatacacttccagctggtatcattacttcttgttcatctgaaactaattccatattacgataacgatggctatctggaaacttaaagtttggattgtattctttacagcgtagagcttttatagcatactcctggaaattgaataccataggagctttgaattcaaaaataacttgtgtgttatactctaaaccggaagcaaaatgtagagctatatttttatcatatgaagctgatacgactttatcaaatgtaataatatcaattccttgatttaatacttgcttagtctcagctggaacacctctccaaagaggtttatcgtttggttccaaacgagatttgattatttcatttaaccaagtatggtcatctggtttattagtaatacaatgaattaaaagttcaatttcagataaattaaacccttcagaaagtaattcttcacgaatagaagcacgcaccgatgcatccattgatttgattttaaaatcttttaattgcattgctgaatatttcattcaactacctcaatatcatacactttaaatgttccaaatgaatcgtgtaatttttcttttgaaatagaagttattttatactttccaattggaatcatccattcttgttcacgtacaatcatcattaagttatcagtacgttctgaatctaatccatcagtatcttcatatgtatacttaaattcagtattaggagaagaaagtataatatcgctgatatggtcagaataattaaaagctttatcagtttttaagcgaaatattatttcagtgaaatactcaacataagaaaaaccacatgctgtgtgcaaactagtagtaaatgaatctaccctattcgttgaaaacacttctccaacttgtaaatctttaatgagttcttttgtcgattttgatataccacgatataactgataaggtgatttagttaaatgctttttaacgattttattcaactgccgatgaagagcttcattctttttagcttccatacattgccaaagaattgactgctcaaagtcagtaaatttttcacagacttttttatacatatcatattgaaaatcaacgctttcagcttttatagataactgttcaacatctgcaagattaataatcatgatagcctccgtatacttcagaagctatcatatcatcgttagaaaggaaagtaaacaactttttgaattattttgcccagggagcccaaggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatattaattcctagcgataaaaaccaaaataacgattagcttcaataatctttctttcttcttcggacattctccagcgtagtccaacatcaaaatgagcccagaccatcttaacaaatgcatttatatctttaatatcttcaataatgaatgatttacttttagaaggttgactcgctaatttaactttatcgtcttcaaacagggcaaaaagaccatattcatgagctcttttatagcctttaatagttaaagcttcagaagaagaaaacggtgaatcagtattctgtaaaatatcttcagtatgctttataattagaataacattttctggatattttctttcttttatatctttaattaaaagatccggattttctgctaaaggaataattaatgagcattttttatcaagtgcatttactgatttaccttctttagacatgaattctactgaataatgttttgctacttcaatcatgtgatttccttttgcctactaatgggccgtcaggaattttgttttcctggatatatttctcattttcttccatcattttactgccaattttaagaagcaaatccagtgcttcatttgctttagccttggcctcttctagcgtcatatctctgttcatgatttatccccatagatatctctcatcaatttaagcgctgagcgttctaatttcttttctttctcagcactaatcattgatttcatccattcttctgattcgttctgcatttctttatttgcttgttcaacccaaccatcatcaatatacatcgagtttggtctattgaaccattcaagcatcttcttcagagctttcatttgttttacctaaaacaacagtaggagcatcatcaaattcatgaattttgagcaaatttggatgtaaactattccatacagaagaaataaagtatgataaagcatcttcactcgcaattataaatttatttcctttatctattttccaactatatactgaatcgtacgaataaaaagataaaggtttatcattatattgttctgcgctaacattaatgtattctgatttagtaaatgcttcaattgctctaaacggaatatttggtacagtttcaataataccaatctttttaagttttatttcagcatcttctggaactggcattgaaacgaaattttctacgagatacattgggtcacaataacccttatcaatcattactgctacagtaattggaacatctttagcaaatgacaaactattactgctaatatacatttcaaacaaaatcgcttccataattttcctcaatcacaagatgtagatgaacaactagaatcacaagaacttccacatgaatcgcccgtccacacatgaacaggaacattagtatcatatgaatcagaactagactgtgtattctgcgtattagatgatgtaggtgttgaccaacgccaaggatttttataatattcctgggcttcttcataagtcatagtaactgcttctactgttccatctcccatataaacatattcaactacagttaaaggaaggtagtcatttgaaataggaactacaccttctccgggagttgtagagaaaaaatctgtaaagaaacttttaaaccaattaaagataaacattacaaaaagcctttcttgaattcgacttgcttctcaccataatcatatcgaatttctgcattaaattcgacagaaccatctgcgtacatcataaatgaatgcacaacaacttctgtagaccatggttgtagttcatatttcttcattacgtgtcgtgaaatgataatatctaaatcttcattcggtttaatccaacgatttaacatagcgctctcctctataagataattctattataccatactcattttggaaagtaaaccatttaaatgaaaaaggactcccgaaggagtccttgaattattaaccaccagttactttccacaaatcttcgtttgcagcaatccattcagtacgctgattttcttcatatacagtagtatatgctgctttttctgaagggaacgtctggtaatgagcaccagaaattttgtgaacgtcagaataaagagggaaagctactgaaatttcctttccttcaattttcttatttccatctaatttctgctcaaatgttttgatattaacataaccgcgagtactagccatgtaattctccttttatttaaattacatgattatttataataaattctcgcggcttttaagacgagctgttaataacctcggtcttgacgagcgaaattttcagcatttttcagataataaagtttaaagatttcttcagccgtaagaccgaggccttggaacatgttcagaacgaaatgaagaatatcaatcatttcgaatttaatttccaactggtcttgtggagacaaatcagtaatcagagtttcacgtcgttcaccatgttgagctttccaaggcttccatacagcagatgcatctttttcaccattgctcataccaccaagagaagtcagaagttcgcggaattcatcatcaatataatctttctgattacgcagccaatcaacaacttcacctgcagtagccaaatcatcaggatgacggttatattcaggtttatctttagctaaacgaatctgcagagatttctgcatgtcaagcattacctgcagcgggtctttttcatcaccgagaatatcccagtattcattttgagctttatcagcgccttcgatcagttgactacattcgttaaagtaagccattatttttcctttcaattcattaataagttaaataattatatcatttgagtatgtaagcaattaattaaaaatatatacttcatcagttccattcttttctttggaatgatatatgttaaagacgtattttttattaagatgcttaacattatattttttagaccattctttaagaagagtgttttcctttccgtgatgctctaaaacattcgacagtccaaattttattcctctgtcatttaaagaatctaaaagatttaaaaggtctttttcttcttcttctgaccaaaatttattataatcagcaactgttatgagatacggaggatctacatatacaaaatcgccgtctaaaattttaacatctttaaaatgcaatgaactaaagattattttatcacaattttgcttaaagtgattaaagcgtttttcactatttttgtttatagttctttttccaaacggagtagtaaaatttcctttatcgtttatacgaatcatattactaaatccgtgaaaatgaagaacataaagtaaaagaggatctctagttttattataatcttcacgtaatttcaaaaactcttcttttgatgtttttgatagtttatattgctttattacttttaaaacgtcatcccatgatacattaataagacgcttatacatttcaataattggttcttgaatatcattggccaatacaggaccattgacgttcaaagacactgataaacctccacaaaataaatccacgaatctgtcatattttggaaagtgaggcttaagttcaggtaataatgactgtttattacctgtatacgcgatagctcctagcattatattctctcatttattgcagcaaaaaacgaattatataattcttcatcatatgtatttgatagtatagtaatactaacacgttttgtgataaatattaatttaaaggaggacatatggcacaaaaattaatgacacttgttaatgccatcaaaggtaataagaaacgtatagcttttactatttctgctatggtaggaattttactctggaactttattttatcaccaattgcaattgcgcatggtgttaatattccagtagttactcttgatacattcgtagatctagcatttgctttagttgggttaatttaaatcttggcatatttagataaccgcattttagccattaacccctgggcaatattatttttcatatattccataatttgttcaggggttgcaccttcctttctaatcatatcattaacatcttttgatttccagggagatttatcccaaaacataaccctttctcctgcatcaactaatttagtcattcgcttgatagtgtcagggtgacgaggttcattatctaaaacccacactcgtctatctttaaatggaacaacttctaggtctaattgaccacccgtaatagctataccattttcaataaaaagtgaatctataggtccttctagaacatatacatcaccatctttaactcgttcgactccatatatttttgttgcctcaggataagctttgatggtgatatatttttgaggagcatctttctttaatgcacgtccttgaaaagactcagcttttccattagcattataaattggaataacaagacgaggctcagaaatttcctttttgtatgttcccggtgctatgctattaactaatttaggccattcggttgtaaaccaaagatatttccatttatcctttggaatacaacgagcttttacatattttataattgggtggtcttccgccagtttatctaatctaacacatgacggaagagatttaattattttcttctcaggttgtttaggaagttctttaggtttttctactggacgacttttacctttttcttttcttatttcaaagatatactcacgatataaatcaggttcaaactcctttaaatatattccgattggcgcatgatagttacagttataacaatgaatatttccttcattattatcaccataataccatccacgggctttattttggtcggtttttgaatctccacaaactgggcatctaaaccgtaatttaaaagttgaactattatttacttgtgtgaatttaggtaaatgagctaatgcacgatatgcaaactcattatcaatccaaggtattgatgacattctttactcttctttttctttagattcctcttttttctttttaggaatctgttcaggacctttatttactacagcacctgatgttgttccagtagagatattttcaggattaccacctgaatctccagcaaccatatcttctttaataaattctttatatgttttcatattaacctctattcataaaagcattaaaaatttggtcatcaatagatggaatagcaaccttttcggcatcatttagcaaatcattaatttcatcagatagcataacacatgtgcctttatttcctgtaattgttactgcacaattacgaacgttttctttattaaattttaggttaatattttcgtaatgaaaatcctttaatgctgaatatatttttaaaataaaattgtcttttactacaataaacccaacctcactattaaaacgtggttcatggaaactgtaataaaccttttcatctataaaatcgtatgaaattttttccatttttaaatatgaaaattcagaactatacatactaacctctaattactcacctaccacttcagcgatgatatttttattattaaagtttttatcgcaatacagaacataattatactgcattacaccaccagacttaagctgtttttgcacttcagctttcatttcaggacgatcgcgctcaacgatattcataatatctgcttcaatttgagtttcaacttcagtctgatccgcagtcatagaccattcacacaaatctttatcataacctgccatagcaggctgagcagcacaagaagctaaagcaaaaattgtagcaaagataaattttttcatgataatctcctcagtagtttatgtttatatagtatctcaattttcaacaaaagtaaacagttattttaaaacttctgcgtaatcacatgttacaaactgtttctctagcttgacgattttacgaaagtatcttttacattgacgaatctgtcgcttagtagggcgcacagcaaacttaataaattccactcgaccaaatggaggactttcttctgccggaatatctaatactaattcccacgtatctgcaataagtgctttgaattgagtatttttcctgacattatacggagtaggtttaaataaaacgatatgcatattatcctcggcaatccacttcacataccttcttgtcatcaatgaaagctttaactagtgctttattaacttcagcatattgagtagtagcccattgaacgtcatctttcatcattgtgatctctttagtaaacatgctttcgttcttaaaccaccccataaaaactacctttaccaattccataacaatctcctcatttaaccaacaagactactataccatagtcttgtcagcttgtaaactaaaattttaattcatttgccaaagcatctaactgagctcgagcggattcgtttctttgatagcgattctgttcagcctgaatttgctgtgaacctgctacttcgttcacttcagttggagtagaatcttgttcaatttctacccatttctgatttcctttttgaacacccatcaaaaacttattccatttattcttatcaccgtatcgtgatttgatttgcttaatgagttgttgttcagcagctgctagctcctcggtttcaatgaccgcaagcataaaatcagctgttgctggaagaccggcagattctgcaatatcgctcatgttaacatcagaagaatcccaagcttgtttaccaacctgtgctgcagtccaaagaacagtttcggtttcaacagcaagagcacgtaattcctctgcaatggctttaacagttgtgtaactattttctgagtaaactctaatgcggcaagatttacaaatacccagatagtcgacaataatgattgttggaacaaaattcttcttgagctttaattcgtttaaaagcgaacgaaatgtattagcatctgctccaccagtaggatactgtttaactattaaacgaccgagagtagatttctcgcgccatttttccatttttcctttatactcagcgtaagaaatatgcccgtcatcaatgtcatcaagagaaacatcaagcatattagcatcaatacgcttagcacagacttcttctgccatttccatggaaatgtaaagaacattatgtccgagctgcaaataatctgctgccaatgaacacagacctaatgacttaccgacgttaacaccagccattaaaacgttcagtgttccagtttcagctccacctttagtaattttatttagaattttgagtctaaatggaaccttacgagctttattcatataagatagccaacgtgcttcgtagtcatccatccaatcatgaccaacgtaactatcaaatgaaattgataatgcttggcgcatgatgtcaggaatagcacctacatctggcattttcttatttcgtttttccggaggaagctcagcattagtttgaatttcaattattttagacgtagcattaaacatcgccctttgctgaacatatttttctgtttcttttactaaccagctatggtcttctggagaatcggctagtttcgaaataagtgtttttacaccagaatattctgtttcagtaaatgaactattttctaatgcaacatttaacgcattaatagatggaacgctatggtactcattaacatgagatttaattaatttgaatgtatttttagctggaccactttcaaaatattctgaatccatatatggccaaacttttgaaaaataagcttgatcaaatatgagatgggaaagaataatttctaccacacttactccttaaaagaatttaaactttttctttgaccttttattgaatgcatcttgcagttgcattgtaatacatttttctacatgaggagctaactcagcttttctttcttggtcaagaacagcaaagtccattacaacctttccatcaacccaatccagtttagttacatacactatatgtgtagaaccatcttctagtttaatgacaatctcctggataacattttccatagcggatttaattatcttaagagactcattaaaaagacgttcttttctttcttcttccccctccgaagagggagattcatcgataatttctagatctaaatctaaatcatctttattcattaaattcttccatatcacttaactgttcgaggtcagtttctaaatcagcagctgatttacttttactttctggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttagtatcttttgcacgccaagatttttcttcgcgaatcatctcgccggtttcttcatcaagaaattcacgagcataccagccatttttaggttttaccacaaatcctaattcaagagccatatctaacaatccagaataaggatcgatgccaccgtcaaatttaacatcaataaagaatttacttttttctttaacggtacgagatttttctacatttagaacaaattgatacccctgaagatcagaaccatctttaatctggcgcttaccgataatgaatacagtatcagccgaatacattacgcctgtaccacctgtcatcacggttttactaaacatttcaattgtttcaattgtatggttaaccgcaacacatggaatgtttttaatactaaaataaggagtaacaatacggaataatgacttcagtgatttagcacgagtcatatctgccacagatttttcattcaaggcatcttccgtttctttcttagaagccatattaccaattgagtcgatgaatacaataactttttcaccacgctcaatagcttcaagctgattcaccatatcaattttcagctgttcaactgactggattggcgtatgaattactcgttccgggtcaactcccatggatcgcaaataagctggagtaataccaaattcactatcatagaatagacaaaccgcgtcaggatatttgttcaaatatgccgcaaccatagtcaaagacatatttgatttaaagtgtttagaaggccctgcgaaaatagttaaaccagactgcataccgccatcaatcgcaccagaaatagcaatattaagcattggaatttttgtacgaattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctattggatgaatagcattaaacttatgaaatgcttctgatttttctttacgcgaaacgcacatgcgaagaacctttaatggctcgtcttcttcacccaacgattttcgtttttcaatattagaagttttccaacgagcttgctctggaaactctctattgatttgctcaagcgctctattatgtttagaattactacgaattgaactgcaccctccaggagcttgtgcttttccagatacaaccagatatttgaacaaggccaaatgcggataaccttgattaattaaattgagaaatgcatacatatcttcgcacaaatcaatttttccatacccaatttgttctgtcgtaagttttccaaggtcataccatgtattcgtgaatccatatgaattttcacgataattaccccaagatgaagtaattttaaaaattggtaggcgagcatgaccgtgataatacccgcaatccatggcatcttcgacgtattgaatcaattcatagaactgttcatgagtcaattgattgactttatccacgcgccgtttatcgtctctctttcgtattgaactcatacggatagtagtatcatcgtcaatcatccagattcgttgacctgcatacatatcagtaattgctttacgagtaccggcaattccattaacatcatcaggaatagttacaattttagctctagacccataggcatcataataagctttttcttcatgttcacgtactacgatatgaggttcataatcagtcggaaacatatcaagggcagaaactgcccctacacgttgatagctcggaattacgaattgaatcatttaagtgccttacatttgtcaaaatggtatcttgtcatatttggcccacgtccttttagtccgcaatgcggacatattttttctatcaaattatgaggttttcctttacgatttttagacatcgtttctttaattattttagctttttctacgccaaaaatttcttcataagttttaccagaattttccttggctcgatttataattccatatgcctgctcatttttaccatacattggattaccttcgcctttcattcttttagaatgatcaggacgcttgattccacgaaaggcatttccgcacttatatctttcttctggagatagtttttaccgtacattccatttaatttgcctggaaaacttcctccccatgcttcattctttaaattatatgaatccggacaattagcatcatctaaacaagttaaaataatttcttcaacctgtctaaacattggtccttcatataatatttctttattaaagaattttattccatatttctttttagcatgttgccaaactacacccgaaccatcataattcgggttgtgaccatcatgacttcctatataccactttttagttttaggatgtttatacttataaacatgtggcacatttacttccattttccagtataatcctttttagcaatatgagtctcaccggtgttccaccaatggtcaactaaataaaactgattttcgtacacatgaagacttccaacgttccatataatagaacctgctttatattgccgcgatgggtcgcctgcattcaaatcagatactaatttatctagtacgtatttttgccaagcataatcattacgatagcctgcccagcaatcattgcttctcatgctaacaaccgcattgactttcttatcacgaatcaggtactgtactgtattagtacacatgaaatctgacataccatctttattgtagtcaaattgcatggatggacgagtataaatcatgataccacgccgagaatcaggattttgaccaagttcagctaaacacatatcatactgggcatagttatcttctgaccaaatagcccaaccataattcgagttaatttcgcctttagaagatgctacctgctgccaaatctttggtgtttcacctggaatatctttaacaaacaagctcttagatttataccattcaagttcacgctgaatgtattcatcattaagagcgccaaaaataaacggttcatctgctacaaatgatgcgccaataatttcaatagttttaacaccagttttatcaactacgaaatctttttcttttaatgcaagccccaaatgaagacggatttcttcaactgtcatagagtcactaatcatttaaacctcaattgatgcattcatatttaaattgtaacagtaataaaccccaccctatgataagagttggaatcatagcaggaactgttacgctatagtatatacttattataaccatcaagattaaaagcaacactgctataattttgcttttcattccttctctctgatgataattacctgatttggctgcgcagactttttagtttcacctacaattgaccaaataaatgtaataaaccaaccaataattgaccagttaaacagtaaagacgtgaaaaagattcctactgtcgattttgacccacgcatcaaggcgatgaaccatggaagcatgtatataataatagccaacacgcctgaaactaaaaccataaaaattgaacctgctactaaagtttccatgttttcctcacttagtcaaattttttacacatgaattataagaattcactacatactccatcggagcatttttaccggtacgccattggtaattattagcccaatttgcccaaagctcggcgcagtagttttcaattttttcttcgcgtgtaattacatcagaattacgatatgcttgagcagattcatctggacgaatagcctcgtcaaaattcgcctgcatttgttctactgtctgttttggagcttctttataacacttgacattaggattataaaacttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacggtgctagattcaatcacaggttgagtatcattttcaacactaacaaatggaactgctgctaatgcaactaaacaaactgctaagcatcccataacaattttcatttcattctccaaatccgtatcagtagttgatagttgtatagtaccatggaagaacagtcttgtaaacagttttgtgaaaattttttagggaattctaaatgtccagaatcatctgtttttcataagtatagatttatattacttgtatgaaaaagggacccggaggtccctagatttattctatcagccaaacaggaagtctaacgaagctttttcttcatagtccataccagccgattcacacatgcccgcaagcggtttaacaaacgatttttggaacaaagttgagtagtcaatccaagacagtacgtcagaacgaatttcttttggaagttctgtacccgacggccaagcaatgcatttgtcaccaaatggatttccttcacgcaatggaagaaccattactttatttccatccaaaattggagctacacctaaaccgctaacagctcgacgataagttagcacaccgcgaatatggaacgggcatttaaatcctggccaacctttatcatcatatttcgctatatcgttcgcagtttttacttcagcaataactttatagtcaagttgacgatattctttctcgaagttcttgtagtattcttggacagactcttcaccttcttgaagaatacgacgaatactttcttcgagagcttcttggaccgctttaggcgttgaactctgctgagtttccatacccatgatttttagatgcggttcagcaaatcgtttatcttccatatcataaacgttcagagcataacgctttttcgctttccaaaatccaccaataccctttgaaccaagtggagggcaagaaatagcttcacggtccatatgcatcagatgctcgcggttattcatataatcacataactcacgatatgcaacatcaatcataggttccatctttttcttaccgaactgattcatgaattcaactaaatcgttctgctctttgaatcggtcaagaccaactttttcaataactttatctacacaaacatataccgaatcagtatcacctgctgcgatgaaatcttcaccattagttccgcatactttattcagatattcattaattttacgagcaatccactgaataccaacttggccgaaaattgtgatagcagtagcatttcgcaaatcatagtaacggaaatgaatattaccaagagcaccataaagactgttaataagaattttacggttcagctgatttgtgttagcaagtgtagccgctttttcacattcttcaatcaaactattgagaacagattcagtataattcgatagttcatttaagaaatcatcactgaacttaacatatcgttcaacttctggtttagttgaacaagaccctgcgcctttcataataatctttttaatagcttcggcattcatttcttcagcgaacattttctttttccaatctttacgctggaaaaatactttagcgatttcctttggaatgataccttcttgatgcttatcgtacatccatccattcggagaacaagaatattcatcactcggtttaggagctgttcctgcgatatattcatgaattggatgaactttaaactgaccacgaatagtctcaggactaatgttaacctgacgaataatgctcggatacagagacgtcaagtcaaaactcataatatatcgacgagcaattggtttaggttcaaatacgaatgcacccggaaaactctgtttaacgtgcgaaccctgttgaggaataaccttatgttcacctttcaatgagttaaaaataatagcatcccaagttttaataggactcattacaccagaaaaaggcattttagcataataagacatacttaaaactagatcgataaacccgcgaattttatcaattgcttgaactgattctacgtcaatgatgttataactaatgtatcgttgatgattagtctcacgaagtttattaataggaccatcatacggtaatttaccttttttggtttcatgttgagcaactgattccaaagagaatgacggcaaattagtaaaagcgaatttcttgtacaaatctaaataatcaagaatagatacgccatcaatagaataaatttctttgctaccgtacatattttgaattagtttagattttactcgaccgattggagagaagcgtttcatactacgttcaccgagaaccattttaacacgattcatgatatacggaacgtcaaatccctcaatattccaaccagtaaaaatagcaggtcgtttctgttcccagagattgatatattccatgagcatatcacgctcattatcgaatggcatataaattactcggtcaagaatttcttgaggaacttcatcaccaccttcacagtcaagcttagcagctaactttgcatcccattttgatactgaaccgtacattgaattcaaaaggtcgaaaacataaaaacggtcgtcaattgaatcataatgagtgatagcatcaatttcatattctgctttcattgggtcaggaaatttatcaccagtaacctcaatgtcacagttagctacacgaacaaattttcggtcataaacaatttctgaaccatatgtatcactgatataagcgagtttaaaatcgttcataccaagagcttcgagaccgatgtcttccattcgcttcatccagtctcgtgcatctttcattgatggaaatttttgaggagcgcaatttttaccataaatgtctttgtattttgactcttccttacaatgcctaaacatagttggaagatattctacttcacgagtacgttcctttccgttttcatcaatataacgttcaacaatgttatttccgactgtttcgatagagatataaaattctttcatagatattccttagtttatagcccgagttattaggctcttgatatattatactccaaataaggggccgaagccccttgcttaaattagtactatttgtcgggtgaaaattgtcaatccatctgcattaattgacttaacgactgcagtaaagtgtttttgttctgggtgaactaatttttgaaattctacctgaaattttagttgaaggttttctggtaaatcgaaaagtgtttctgttgcagaaagattatatttttctttaagagacgccatgtattcttgcggagttatagcagtcatattaattaccaatcgtatatttaggaacgagtttccattcatgtttttgtttaaaagaaataactcggaagttattagttaaatctttcataaaagttctttgaccaggaacgatttcaatcagtccccaatcttctaatagccatgcaatcgaatcacgacgaacttcatcttcttctgtcatttcaacctggcgaccatccatacgaagcatttctttaaaatgaacgatatagtatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaaaccttttagttcttttaatactaaaggaagttttccatttttagtaagaattgatttatagttaattgcatcatttgtattaacttgataccgcttagcaagtaacttaataatcaatacttcggtggaatcttcaaccagttttgcccatttaccatatcttttaccacgaggaactgcagccattagataattaaaatgagcttcatcacttaatccagaaccgattaaattcatagcatatacagctggcatgcactctggaaattgtgataatgcattttcaaccatgaattttgaataatctttttgagcaatagagcatttagttttattattaatagctccaattatttcaaaaaattcattttcagctttttctttaaaagaatcagcagcggattggacagctgtccaatcttttgaataccaagcaacttgatgctcgtttaattgaatatcatcttcaaataagctcatatcacttccactgcatttcgcatgctaattgaatgaaaagataagctaaatgcaattcagtattagctgcaataccatgatactgattattttcgcctacaatttcgtacatacgaataatactctgcggagttacacgtgaatagatttcttcggcaagtttaccaacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaacgtaataactcggcagcgtgactgaagtggtttaataataccatcaatattgttagcagtaataataatactacagtttgaactataagcttccataaaggaacgaagatgtcgctgagattctgctaaacctgaacggtcaaattcatcaataacgattactttttgacgaccatcaaatgaagcggcgctggcaaaattagtcaaaggaccacgaacgaaatcaattttacaatctgaaccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctctattaaaaatcatgggtagaatcagcttcaagagctactacataattcgcatgttcaccttcaaatttagcagcgccttgtttaccttttgcccaaagcagaagtttataatttcctggttgcattttcatatttgccatattgataatgaaattaaatgtgttttcaccatcataatcaccaagagtcaaagaatatttaacacgggtcagagcagaatcttctactttattaaaaccgttaattacgattttaccttcttttactgtgatagcaattgtatcaatctgcagaccgcgagatacacgcaacaactgttgaaggtcttcagctttaatttcagtaacaacagatgctaccgggaatggaattggtttattaggagcaactactgtactcggatcggctgctggccaaaaaattgttgagcgggcatcagcaattttaatatttccatcttctgactgggaaatttctgcatcatcattaactagagacagaataccgagaaaaccgttcaaatcgtaaattgctacatcaaaatcaataacgtcagaaatatttgcttccgcataagttgtaccattaactgcgcgagtcataataaattgaccggatttaagcataataccagagttaatagtagcgaaatttttaagcagagcagtagtatctttagacagtttcatgtaatttccttcaattcaaatgagatttaattttataactaatttaataaagcaattaacgattaaaatcagctgcgattgtttcggcaacaatttgagcggcaacaatcagacgttcatctgcattgccacaatattcatcttcaaggcgttcaccacatgaagtcataataaatttagcaccagcgtttagggattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcatttctattggacattatttttgtatattctgctttaaatgcattcctaagcatagattcagtaactatatgctcttcattagaaaaattatttctcagaatatatcgttttatttcaggaatagttaatagatgctgtccggttgaatattccatgtttttcctccatagagattatactctaataaattaaagcataatctcttataaattaaaccattacagtaaatcgaccaactttcttcatttgaagatgctgaccgtatgcttgcgggtcatggtctctatgcgaaataacaaaaacgttagtattttttaaactatctaaaatagttgaaatagcttttacaccttcaacgtcggtcgctgaatcaaaaacttcatcaagaattagtgtgtttattttaacacctgaaactttttcagcaatatcacgccaagtaaataaaagagcaatatcaattcgtgctttttcaccttgactgaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagctgctttaacttttttggctttatctaccgtcgtgattagagattgctttttattgcgaatatcatttgccaacgactgttgggttttaatattatctcggtattcatcaacaagaacttttaaattatcacgatgtgttgaaagctgttcaaacgaatgcgtacattcagaaactttatctttaattttagaaacaactttatcaccggaacttaattgtgacaagcaggttggacataatccaccttcgtgatacatattaatgactttattatacgagtcaatttttgatttaattaaaactgcttcttgaccgattttattaaatgcatcagtcgggtcttcgtctaaaacaatattaactaatctttcattagcttcttctatttccgattttagcgttctagcttcttttgccaaatcatcatacatattttgcagacgagtaaggttgtcacccgttaattttttctggcgttcaacgttatcattatatattttaatttgttggataatactatcttttttaacatcaagcacttggttttgtgaatttaattcgcgtattagtgctttattaagcttatccatttcagctaatgttcctacctcaagcaagtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcgaaaacgttcggtttttgtcctcttttgatatagtactttttctcatcatattccatccacagttcaactaaaagttctttcttatttgtgctgtttattaattgacctttctttacatcacgaaatggcttgccaaaaagcccaaatgtgatggcttctagcatagtagacttaccaccgccatttcgtccagtaataagagttttttgaaccttatctaattgaatgtcaataggatttccacctactgacattatattttgatacctaactcggtttagtttaaaattcttcacaaaagattccttttaatgtatcttttagaccattctatcatatcatcataatctaaaaagtattcatcaaattcagccatgcaaacaacaccttgtgctgtttttgatgtaatataaattattccaacatatctagaatcttcttcggtataatcaatgtttgctatgaattcatcattaatgtcaaatgtcgaaaacttcacagtatgcatccttaatacaagatacggccatatctcgcaatgatttaggtgtgtcattatctaaaatgttgaagttaaaagatacagcccaatctgtacagaccgtaacctttttaatacaattatcttcaacctctaacggttcaaaccaatattcaataatttctttatgcccaatatcatcttttacttcgcattcaaaatgctgactcatcataacatttttaaattcatcaaaagtcattgtgttgcctctacatataactgatttgcatattgaataagtgcttcacggtcagaatcagtgatgtctggaattgcattaatgtattcttccatcaacgtctgaagagattgaacttcaacttcttcactgtcatctgactcgacagagttatcaatctttgacacaactcgtaatgaatgcacaactttttctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcacctgcagttagtgtccatggtgtcccaatatatctgacgttagcagcctcagagatagtatggaagtgaccagaccacacctctttataagtcttaaggaaatcaggttcaagaccgtgagatttcattcctttataaaaataaaatccattcagttcccagtgaccaacacaaaaagaagcagatgaagttttgatatgctcaagaatttcaccagtattttcttcacacatccaaggaattaaatcaattaaacatccgtcaaaatctactgtagtaggcttatcatatactttaacattaggatatttagccaaaagctcagtagaagcatttggatgcattacatttttgtagtggagatcgtgatttcctacaatagtatgtaatgtgattccagcgtcatcaagcatttgaactatttcacgggcaaactccatagttttatgtgtgattgcttttcgcacatcaaaaatatcaccatattgaatccatacagtaattccatttttcttagaatattctatcgcttgcttaattccatcaatttgaataccgcgaatccactcatcatcagctttaacgcctaaatgccaatcacccaagtttagtattttcatggtgtcttttccatcctaatttagctgcttttgaaactagttctttaatttttccttttgtccattcaggaccaggaggttcatgacataacatttgcttaactccgttattataccattttttacctttattatgtgatgaagctttaaatttatttgaccttccttttacataaccttctggaatataaggcaaaaaggcagattttcctgttaatggatcatgtgaatgtatatttcctttacaattatgagaaccatataatggatgattttgtcctttattatctcttccaaatgaaccttttggagcagcatatgacatattaaagaataatggatttttaactgcatcatgcaatcgttgataatataactcgcatttaatagcttcttcacgcgtatcaaattcagctaaaatgcatgaatcaaataagtgaggattatctgaaagctctttattataaattttcttatactttttagataaaactgaaccatgatatccagctaaatgcctatctaaagacgtagatccaatataaaaaggaggaagtttatctccactatatattgttaaataagttatatattttttcatatatcaagaaccgtcattgaaatgcaaaataaaattattgaaataaatccatctggagtgctaaagaacccaatccaacatgctctagtgaatagataaaatgcaagaaaaagtatcacatatccaagaaatatcattatatcaaactccatataaagctaaagggccgaagccctttattttgtaataatgtcaaactgttctttaaagcagaagcttgaatcttgatgctgatacaaaaattcataagctttttcgcgttcacggtcataaagagttcggtcagatgacagttctttaatacgttcaaatgttgattccatgtcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaactgtttcaggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcgtattcttttgctaataaaaccggaattgaaaatgatttataatcatgcgcacaattacgagtaaatgatttatctttagcataaaccaaagttacttcatgaccatttttaataaaccaatcacgctgctcaagagaaaatttagttacaccgcaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcataactgccaccattttttgacttgataagaatcaacccacactttcatattggggtctgctcttacaataggaggattaacttctttaattgaactatcatggtattctttttcagaaattttcacacaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgtttcagaatatcccgacttttcttgatagcatattcgtattgagcaaaattattgttttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgttggacaaatgcattaaaacaagcttgagttatatacgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaagcagtatgcttggaacactttctccatcatctttttaaattcatgaatatctatgtaatgatcattaatatcagcgcgatataaaaagtctaaaaactttttatgggtattagaatatttacttccagttaattcagaaacatggctttcccaatatccaacaccagttttatttgggaaaaatgaaattttcatgtattggtcaacatagaaaataccaaaattttcaatagcaatagaaatattaattaatttcatacattcatcaacttagccgcttcaagagctgcatctagtgaatcaaattggtcaacatattcaatcaattcgccgtaattggcatataaccaccattggctaaattcatactcaaggatgaatccatttccttcaatttgagttaaaccattgccgtttgtatttacttcatatccggcaagacgcaaatcgttaataagagcttcgttcataattataccttagtaattttcaggtctgcaaattttttcttacgttgatttttcatgcgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcaaagaaactactttatcatatgcgtaagaattgatggcgtttttaatttgaatagtcatacattatcctcaattacgttaaaattttattatccaaaaagggccgaagcccttagctaaactttttggcacccttccagccttcgtacatcattgcgactgacaatgacaaagctccttcacatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattaccattttcatcaataaatttaatccagtcatttactgaccacttagttgtatcaccttttggggtaacatttaaaatatatagcccttgcttaaaaagcattcgtttgatattcatattttcctcagctgtaacgatagcactcgtttgatttacgtttagcaactcgttgagaaatattataatcaaaatcatcgtcaatgtaaactgattttttcaactttcttacttcaccacgtaattgacgattcaattcattcttaacctctgaatcaacacctcgcatacgtcgccatttatctgagcgaaaaatgttttcaaccatatctttatgacttacaccatcaggagctttacgctttccgaaatagtcataatcacgcacttttaagtctttacgacgatacgttttacccatggagtttaatttccttagcaactgaactaaatgcagcacgatcgcaaatcatgcgtttatgtaacttgagtataatatagcaaacttcaaaactatttacatgagtaacacgaacagcattaccattaatgagataatactgtccctttttaatttctttatcaaccataaccatatcaattcctcaaaggcaattcatatgttaataataccacagtttgagctcgttgtaaacaactttgtgaaaattattttagggaatgataagaagggaacgatagcttagaatggtaatatacagaatgtgagaaagaaggacccagagggcccgtcttagtcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagcggacgatcatactcaatcttaccgttatttgtaagaactttatagaaagtaaaaggagcattgagctcctttagaagttttgtaactgattgacatccaggacaacgacctacttcttcggggatgccatagatttcaatcttattctttaagttcgagttttgttccacgagaaataattccttgataagcccagtatggcgggttaacagaatcctcaccagagttttcttcaggaaaataaacctggataacgaagccggattcatcaaaggtgaaataagtagtaggcagttcacctaacaaatcggcacgagcgttgatttcttcgaggtcttgttcacgtccagcccagaagcttgggttcagactacattcatagaaataatagtcattaccgaacatatcaaaaccattccaactctctactacataccgctcaaaactaatcataattaagcctttttatcaagaacagcattcagcttgttagtaattttatccagacgctcattaaactcactagaagataatcccttttctggagaaattaaactaatcacgaaaaatatagcaataaaaggaataaggaaaatagctccaactgccataaacagaaagaatgttacagttgtaagaaaatcagctaaacctttacgaaatttatacatattttacccttaattaattaaccaagcattgataagcactaaactatattgggaataaaattctggaccaaaatgaaaaatcatatcatttatagtatccataatgtaattcagtttaatcatgtttccacaccccatcggtatttgaccaaagtcgctgattatctgatcctcgccacagctttttggtcggaagatttttctcatacttcccatcaataataacatcaacatatttaagcatttctagttgtttaatatcttcaaacttatatcctgtccacaaccaaatgcttttattgggataaagatttttaatagtttgaaccacagagtgaatcacgtctctgttatcaggataaagagggtctcctccagttatagttaatccttctatataatcattattcaaacattcaattaattgttctaatgtttcaccagtgaatggaataccatttctagcattccatgttgatttattataacacccttcacatttatgcaaacaacctgtaacgaaaagaacgaccctgcatccagggccattcacaaaatcgcaaggataaaatctatcataattcattgatgcttaaccctatgcatgatttctttatttttaccgagattaaatccgcgttcgttcgggtttccaagatatccgcatgttcttcttattgtgttcatctttttaggatcagtttctccacaaatagaacaaacaaatccgttttcagtaggagtcatttcatgggtacttccgcatgtaaaacacttatctactggcatgttaacaccaaaataatctaaatgttgtacagcataatcccatacggcctcaagaccttttaggttatttttcatatcaggaagttcaacataagaaatgtgaccacctgtcgcaatgaaatgatatggcgcttcacgagaaattttttcaaacggagtaatattttcttctactgaaacgtggaaactattagtgtaccagcctttatcggtaacatcttttacacttccatatttttctgtatcaagtttacagaagcgataacaaaggttttcagcaggagtcgaatataaactaaaagcaaatccagttctttcagtccactgtttaagatgagcattcattttagttaaaatttcttgtccaatatcacgaccgacaagaatattcaattcgtgaataccaatgtatcctagggacactgaacttctgccgtttttaaataactcaattatgtcatcatcaggtttaagacgaaccccgaatgcaccttcttggtaaagaataggagctacagttgctttaacaccctttaaagaactaattctacgcatcaaggcttcaaagcacagatccattcgttcattaaatagctcaacaaatttctgttcattgaactgtgttccaatataagaatctaatgcgatacgaggaagattcagtgttacaacaccgagattattacgtccatcaagaatttcattaccagtcgaatctttccatacgctcaagaaactacggcagcccatcggagaaacaggaatagatgaaccagtgatagctttattgttcttagctgaaataatatcaggatacatccttttgcttgcacactctagagcaagctgcttaatatcatagttcggatcgtctttataaagattaacaccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggtgtttgcccgtttgaactaaagagagtatttacttcatattcataagcttgaaatgcatcgtatacgtctttttctgttttagattgagcataattcaacgcatcggcgatttgccatttttctgcatcctcaatatgttttgcataggtgcgtttaacataaggagaaagtactttatctacattcgcaaaagtcgttccgccgtattggtgagaagcaacctgtgcagtaatttgtgccataattgcagtagcaacgccaattgatttaggagtttcaatctgtgcattaccaagcttaaatccgttctcaagcattccttttaaatctactaaacagcaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaactgtgttttggtgtcagattcattatattcaaatcctctttgaagcatctcggccatcatttcctcttttcctaaacgagaaaattcctttgatttatctccaacaaagttagggtgaatattattttgggtgtaatcggattttaaataagtaagtaaattttctaaccattcaagataatcaacaccttgtccctttaagccagaacgattaaatttatgcttcatttgaccttctgcggcattgcagagattacaaagcaatccacgtatctttcctgcttttggtccatttaattcatggtcatgatcaagatgattagcttgaacatcaggatttagttctcgttggcaaattaaacatttaccgttttgtgcatcataaaatttctgtttttcttctttatataatttgccagtcaataacataataaacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgccttgtcagaaaaagaattttgagttttttcaagtattataaaacatttgatgcaatcgcttatattgccgaatcatttggtcagaaaaagaattttgagtttcaagccattcaatatattctgccgcagcttgcatcaggttaccttcataatcatcaatatcttttttcaatgccactttagctaatgcatatgaaatacgttcaccttgaaaagcggctttaggcttctgaacatcttggctagttctctctacaacttcctcgatttcaccattttcaacggattcagtattccacaaacaccaatacgtaattggcttatcatagatgttaataatttttccatcagaaagttcaatttcaataattccagtgtcaggctctatatcatcttcacattcttttgcaagttcacgaactttaaagacagtacctgcactaagttccggccagtaattacacagccctgtatcagcacgattaattctaaaccacttatctactgtaatcatgtcccatctccatatcaattaagtcatttatcgttggttcattatatactgtttcttcatcagtgtaaaccggttcttccggctctggctctacagtttcccatctagccgcccaccaaggtttaaccccgaagcttattaagttcttcataatcaacccaggattctaatcctgatggcaggtcacattcaatttcccaaagaagttcttcaattttatgaagacgatctaattcttcaacaggaatagtaaccattgatggagctcttgctgcactaatatcgtatatcatatttaccccagtttgaccatgcaatcaccgtatttccacttagaaatagacttttcaccattagaataataaacttcgagtttagcacgattatttttaatttgaataaccttggctgtcattaaagttccatacccatagtaaactgcaacttcatcacctacatataccgcgcttccgcggtaatcatggatataatcagttccttcgagcatcatttaaagtattcccgcaattggtcaaatccaccaatatgacttccatcaggagcaaatacctgaggcattgttaagccgatttgagtatcacgacctagtttagtcagaagctcagcgattttctcatcatcaaaaacacctttttccggcataatgttgataaattcaaacggctgtttcttcacggtcaaaagacgttttgcattatcgcaatacacgcatttgtggatgttgctatcataaccatatactttaaacatattattccttaattcctaatacttgtttaaaagtctcgtcgtaatcaagactttggcctgtttgttctttatgtttgtatataatatcacttacttctgatagcatatttttatatgaacgagttaaagcagatttaagcacgctgtatctatcaggaaatttaccatgttcattataatacgctattgctaattcacggactgccttttcagcaatctccatatattctttacgcttggtcattttcttctcggttaaatcggtgtttgcaatgacgacatttataacgaagaatactagtctgccaatgaactaattgtacctgttcagtaccacactttgggcagtttggaacattcttagaagattgctcacgacgactaaccatagccataatggcatcccatgctggaggtttaaagtctaaatcgtcggtaactagcagccctttatcaaacccagcgcatggagtccattcaggaaaatctgaagcttcggcaatatcttctaataagcgctttttcatttcagtacctcaatagcattacgtaaaccatttgcttttgcattaagagcttttaacaatttggtgtgttcggcaatctgggcttcaacttcaaccagtcgagatttgagatattcgcgttcttcactcaggttatcagccttttctgctttaggttcttttacaactggcttatatgtattagggttcttcagtttaattagaatgcgtgaactgtacagcattgaaccattatcttcggtttcgtcatacatttctactacgtccatgatttttaacatcatgcggagtttataagacaacgaacgaatagttttgttgtgcttattaatttctctagagttcatggtgccgagattacgtgagtaataataaggaacctggatattaattagcactgatgaaccacctggcttatgtgttacttcatcagcaataacccaatccttaacatgaactgtatttgtacggtcatcgcccgcggtaaatagtttacgagcatgcttaaaaagcatattcacttggtcattgaattgacaagcgaatttatcagcaaatttagtttcgggaatggtagataaccaatcagccaaatgggtctttttaacatcgttaacaatagtaaattcaaccaaatcggttatagatgtcgcagttttaatgaatctcggcttcataaagtttttaatgttatcgcgagctacagtagaagataacatacgagaacgtttaaaccattcaagtaaattgcctaacgaatgagaataagcgttctgagtatctttacagatatgattttcctggccaacatactgaaggaaatcacgaagaatattattgattactgctctgtgtccgatctgataattacggtgtttagtaataaggctgtcaaaataatcaatataatgtttacgagttttcatgttcttctcacttggttaatgatttatactccgagccatccttggctttaaattacttaattaactgtaaagcttgttcaagacgatccaggcgattaacagattcttcccaaatccttttagcctgctcatattctttctgcgctttattagaaatttctagaacttctttataagctttttctagtgcaataacttctggacgaatttctactggttcaggcgaatcgtcaagacattccattagttcctcaagggtagtttcttctttaggagtattcacaatttcatcacatttttgttggtaaatttctttatcagtcggtgagtacgcacactttacttcacggagactaactacaattttatatccttcccaaccgcatatattcttaaaaggataagtatgaatattttctactgtttccatacaaagtaatgcggtctctaactgacgagttatatcgctagcaattgagaaaaatttattaatgttcttttgattagcttctggtgtaaaaaattcataattcacaaaaatagctgctttatttttatcaagctcatattcttttatgataatcatatcagaagtccaaggatggatttgacgataatcaccatagcataatttagaagctgattttagaatttgcttcttgaaaagtctaaaattactaatccaacgacgagtaaaaatattctcagggtcttctttattattaagatgataagaattaacatcaccgaaccaactgtatcctactacatctttagttcgtttaatttctttcccaaatttaccaagaatatcttgattaactaaatatgaaagaagacgagaacctttaaaagtttccttaatatcatctttatattcgcgactagaaattttatgaacttcatgaataaatttgctggaagaaacaatacttgcatcagtattattgagccattgattgataatggaaataacactattctgactaaacacaggtttaactttatcatcaataacgctattgaatgatttgatatattcgttacgagtcatattaatctcctcagtagaaagtaagaacattataccacatccttgtggcaaagtaaactagtttagtgcatttagtgcattgttcagtttagaacgttgcttcgtaagatttttgactttttcttgtgctttttctagcatcttttcagcttctagcacttcattggtcgctttaacgagttcatcatctactgtcttaagagacttctcaatcgcatccgcgtgccatttttcaacaggtttaagactcggattttcaataggaagaaaattcactttattaaatttccatgcatctttattacctgagctatacatccaaaatttaggatcgtttgatgagcaattagataaatttaagttatcttgcacttcctgctttttctcttgcgggacttcgtcctttctcaaaaaatcgtatttaaatgaaacgatcatatcaagttcatacgttgttgtatgttcccaatttcgctcaaaatgaggtaaaatcttagattgaacagcggcaacaacatccatatacttaaatgcttctgtcaactgtgatttaaggcattcacaaattgaaagagaattttttgtattaggtttaaagctaattcgtgcagttctgttattttcttttaatggtcttacttccatctgaagagtataaccatcaaatttcaggttctttaagttaatatcagaaccttttaatcgactagccgtcgacaaaatttgctttaattgtttacggaatagagcaataaatctccattcaatacgataatgatttggattaaaaaatccagatgataaattaaccttactctgaccaacgccttgaacaaatagaggatttttataatcaatagttttacagaaatcggtgagctgctcacgagcagtcatttgtgtaatataccccgctttactaaaatgacgtaaccattcactgctattcatatatttaaagtgaatatcacgattaactttatcagggtctaaattattttggcacaaaaatgtcataacatcacgagtatagctggcattacgaaccatatcttcaatttgagaacgagttttcatagtgttccttaagatttaagtaaatcaacaattttaattaacttttcacgctcagatttagctttactactcagtccagatagtctgaaaatttcatcatcatattgctgaatagaaatattcagctcttcaatctgcttattaaaataatcaatttgttcagaatgtttttcgttactacgaactggtacaggttttgtaggtaatttagatgaactggattcatcctggcgataaattaaaatacaacttgaaccaattggacattttgcaccagatgaatattctaatgttccagcttcttttaaaacttcaaaagctaaacagagatgatgccccatattgacataatctgtagagcgagctctgacgtaataatcatctccgcgaatactaaatttaaagcatttaaggtcttctgtattattggtcttaaaaatcatttgtttatctagacccttagctaatcgagcgcctaatgctaataatcgtcgttgattttcccacaaatcctcaatcatttgatcgaatgataattttggcattagtcgaccataaaggtcatatcctttattataattacgaaggatttcactcgcgttaatacgagacaacgctccaattttattaagggctttcataatgcgattagataaacccattccagacccgtttgttcgttgtaaatgtttttctaatccaaacccaatatcaactttaaatttatctaaaatttcagcatgaacgtctctgtcaataacattcaaatccaaagttgggttaaatctatgaaaaaatttatctggctctccacgacgaagtacagtccattcattcaattttttattaactaaagatttaattactgcattgacattattaattactactgacatattttcctcactcaatttcaattttactaaatatacagaataagatggaacagactatataagcaccacacacagattgaactaataccattccaaagaaccaaacaatattatcaaacaatgtctgttttacgtcgaaaggacgtaaacttacagtaatattatcgcctttttctattgatgaatacatctctggtgaaatatattcgctaaatctataaccgtctttgagttcatatacggcaataaacgataaactagacccctttccttgagttcctgtaagggtattaactacagtaacatcataatctttataatgcatataatcattaatagcataataaccatatgcaactactacacataaacagcatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttgtaagtttcaatacgctctgaaatgagagtgtatcgttcatttactgattctttcataaaatcaggaatttcacgagaagctttaatctcgtcaaatttatcaataacagcttgctcttcagcaattaagttatcatacatcaaaatatctttcttgatgaactcaatatcttcttgagttacacgagataatttagatgctttatcctttttgtactgttcgttagtatcacgagaccagtgtaatgtacgatttttattcgtattcttataaatttctacaataccaatctcatcaataataacgatccaattccaacgggatttgtaaatttgtcctccatcaaccgtgatttcacctccgattgagatgtcattaaagaacttgctttgtgcttcagatttaaatttaccatcgttgtaatttaccaggttgaaaatatctttagcgttcattttgtgttcctccgtagttgatagttgtatagtaccacagaggaacagtcttgtaaaccactaaaagaaacttctttcacaattttttccactgaaccatgcgcttaccgctttcttagtctcaggagcagtgttatccataaaccattcaaaggcagtctttttatgattctggagggcttctcgggctttaatctgctcacggtctattaacactaacatatgagcctttcttgtcaccatgggcttcttatgattttttgaatactcccagtcatttgtccatcgcattgtcgttgcgaacttaaatactgcttctttaattttagtttcgtaaatttcacgagcctttgagtataacatcattacctccatttaccagtttaattctagtcatctttttgatggcagtccatataatctatttctgaactgcctttttgtcttagaaggcctcttatgaatttatttcagaagagtaacctcagcgatttcttgccaaccgtttttgtcggtcataataaagtcagcaagataaagtgcagtacgcagtgaaacattgcgtaaacgattaacattgactttcatccatgataatgctttataagtttcttcatcagaaagaccgcgcttttgcatcatgtcggttgaaagaataacatcttcaaccctgaccataatttcttcattagtgtgaacacccaaatctaaataaactgagcgggacactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagatgcagtgctccagcagactttacgggtctctccagtgtccagagcagctttcagaagattaagaatgtccatatcagagaaaacatccacatcatcaatcaaaaggacagaattctcttcacgattattccaaagttgttcataaagaccgataccggagattttaccgttaatgcttttatattcaatgtatccattatcatttgctttattcaaagctttatctaaagaatacgttttaccaatacccgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcacctaagagctcaaaagttccagagatttctttaccgaagtagatacccttattgatagttacagttttcattttattctccaatctcacatttgttttgatagggtaatagtatcacactactacccttctgtaaacaatttattttaacgttcgccaaatttttactgcttcacggcgagatacttctacagctccaagttctacagctttttggcgtcggcgagcgtgtaagtcataatgtttaatgcgtttatcttgaaaccaagaacgtttcattcctattgcttctgccatttcatgaagctcttcaatatctccatcagtgaacatatgacaatttttagttggatgaccgcgaagtttccatccatgattcattaaaacatctacgtaaactgtcattgattcttctccaaataagtttcgataattttctgagcgagataaactgcattatcttcagttgcatcttctaagaaactttcaaaacactctgaaatttcttctgtgtcaatcaacttttttacttcaattggtgtaattttcattttgtttttccgtttaagtgtttgttttgatagttgtatagtaccataaagctttatgcttgtaaacaattttgtgaaaaatttttgaaataaaaagggagcccgaaggctccctatcatttataataacttcggtggttttcaagataaaccctctcaaggaagtcatcccaaaaacccatgtctactttttgctgcataccgttcttagaagcttcagtagatgctgcttctacttgatcgaccacatcttccaaaaactcttgaaccgttttaaatggatgtttacccaacttcacgtcgagaataaatggagcatcttggagtggataaaccaagtcaccagttttgtaaatttccaatagttgaagtccaccacggcaagcatgactcagagctttccagtcaataccttcattggcttcggctttacgagcacgttcaccgtattcagcatctaatttgttcagtgactgcttaagctcaataagagaaagcgttgtctgatatttacgacccaacactgtgtagaacgtctgtgggcctgttttctcatgattatggaacacccattcacagaattcgttttctggaagacgatgcttaatatcttcaactttagtacgacgctgcttaatagaaccatcttcttggtaatcaacccattgctcagggatttgattaactactttcaatacatcacgtaatgcagccaaacgagaacccttaacgccgtatttagaagcttgcttacggacatatcctaaataggatttcatgttagtcgtataaaaacgagaacggttgtcttgaataaacttccacacatcaggcaaatcagatttaaccactaactcaggtggagtgtgaagcatatctaacgctacagtttcaccatctgctgctaatttaaagaaatatttaagactgtatagttcatggtcaatatcatctttagtgtttttagatgatgtgttgttagtgtttttactcatgtgctctttaacatttccaataagaatatcacgagcaggaggaacaaagatttctttaaaatctacatcagattctggggtagaagttccataaagatgactaccaaaatagcttttcattactgttttcatcattcagccttatattcaataacaggacatactttagctttacgcgcttttaaaaattcgacgataatagatttcttgggttgaataggaggtaaacctttatacgccctatcaatattttctacatgtaaagcataatcctttttccatttataatctttatatttttcacgcaaatgtgcaggaataacaaatgaaccgataataagtaaaacaaccaaaagtgcaagtataaatgccgatggaagaagagtccataaactaccaaaaataagccatttctgtatgatttctgcacagataatagttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattatcctttcattgaaggtgtaacagttgttaaatacttaatcatagcttcagcttctgattttgataatgaaatttcttcattgttttgacgaatagaaataaaatccggatgacggtcaccaccagcttttaaaacacacatataagtatcagtttcatcttcaatatctgaaatgattgaagcagttccacatgaatgtggtttttgataaatcaatacagcttttcttccaccgtttgactgttcataaacttttaacacatcaaacaaatcgcttcttttatcaatagctaagatgttgttttcatcttcaatattaaatccttcggatacttcataaagtgtcacccataaatcaccaatatcaataacagcgttcacttttccatgactttcaagagcattacaaattttcttaatttcatcataactcattttaataatatcatctccttgaataaggaagatgtcatttttaaattcaacacgaattaaaccacttccacttgaaataaacatatttcctcactttgaaatcatagttggaatgacagaatcgagataagtctttagcgcaatagcttcgtctttggtaaatgtgacaatatgtgatcgaaaatcgtcgatttggcgaatagttaagacatctccctcttcataacattttgatacgtttaaaacagtttcatcattctgattgcaagcgttagtaataatagcattgcaatttttgagccattttaaactatgttttctttcattagaataataaaaatatttaatcttatctataaaactatcccaatggataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgtgtcaaacgatacatattatttactttttctatagctaattcaccaaaaagcggactaacttctaatactaatcgtttcatattgattctcttcgactcactcacaattacatactcctttgaataatatcaataatgttgttcaccagattataagtaaacattgggtaattatattgaatcattacatacacaacaaacaaaactttcattctcttctccttgacagttgacaagattactataccataaccttgccaacttgtaaaccgttaaatgttgttttcaataaaattctgaagctttgtgtgagcatcaaccatgattttcatttcttctttggcgaaagctgtacctctttcccgagaagaacactcatagtcagaaactgcattagcatattcttcaattagtttcattaaaaacatctgcttttcagttttcattgttccacctaatcatttcaagatattgaactaacttagctttagatttatccaaatcctttttagctgcttctataccatcgtatgaatatccttcacaatgctcaactgctaattgatatgaatctatttcaatatcacgtgctaatttaatgattttttcaaactgttcgcgtgttagcatacttacactctcgtattatgatcgataatttcatcaagaaacatatctaacgcttctatagcattatccactttagtttcaaagtctttaatgcctttattcgaaatacccgatgaataccaagcaaagtcaatcagctcttcatctgctttgcgaattgaagccactaattccttaattttatctgcttgttcaatgctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattgagtgcttcaattttcatgatgttctcctctttatccgatggttgtatagtatcacagctcaaattgaaagtaaactggtaaaatgaaaaaagtctcccgaaggagactaatgttattcgagggaaagaagatatttgctctggtaaaacatcccagtaatatcatctatcgtgctttgaatggctggaggcatttctttataaatgctgttagattggtctagtatgcgatcaatcattttaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttgttttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcattccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcgcgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcatattcacataagctattaattcgttttctttcttatcaaaccgatcagcaaattcttcttgctgttcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattaacagcgagttcaattaaattatcaagctcacgtaacacttcatactgtaactcaaaactattcatttcggtttaccttctttaacgaaatctggataaggataaaatcccgaataaaatccttcacctttatgattgatgcatcctttattagaacaatagcaccaataatcgaaatcacaagccatttcatcgttgcataaagcaaaaacaactggccatttacacttttcacaatgggcatttttaagaatactagtttggctcataaccatgtaacctttaagcagtattcttctacatgctgtttacgacctttcttatcaataaaggtatattcaacgaatgttccaatgtagtctttatctacatcatgcggactattaattggacatttagtacggcaaatgcgttcccattgacgaataattactgccttattctttgggtcatatggatgtggataatgtatattcataataacggttcccaatcaacaatcacaatttctaatttagaggaatatgtatctaaaatcccctcaataatatcccagttccctttacctatgcctgcaccaatcctaggcatatagattgtaggtttaatcagtttattttcaccaaactcatttaattctaacatacaattcattaaagcggaatactcaaaatttggccctggttgaaattgagtataaaggttgaagcaatacgctttatgagtcctaaagtatttttcatagactgagtaagaaccgagtttagttacatcaccccattcagtctgtaatttatcagcttccaaaattttagggaaagctttggttaattgacccgctacgcctgaacccatagtatgaaaacaattgcatccatgcgcaatatttttaccttcagcgaaaagggcgacaatatcgcccttgatatattttacaatcatctagtactcaatcctcgattataagaatctaccaaacggtcaaccattgaatgacaagcggctttatctttctcctccgcaactgaacattctaaggtattccactttttagcatatcgttttaataatgtatcgtttttgtatctgcttgatttatctctttctccgtctttatatgcatatattaatttctgcgcaaattcagcttggcatgctttatttttcccacaataatccgcggcagtacggtttacatactctctaatttcagtatatgatgtatctgctaacgcagaaaatgaaattaatcctatacataaaaccaaaattttagtcatttactatttccaaaagtttattatttttaaggtaattagccttttctaggacttcagaagcatatttagaaccagctttaacattccatcccgaattataagaggatattgcttttcttatatcgcccttatgtatatttaaccaataagaaagttcaatgtacgcccaggaagctgaattggaccgtttattcaacattctttttatttcagcatcggtcatattataaccaagttccttgactctcgctcgcatagtaggcaaataattttggaacattccataggcatgatgctttggtttagattttaaattaactccgccagagctttcttgccataaaatagcagccattatatgacctaatccgctcttgtggatatttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactattgataattgccatcctgcattgaagcgacgggtctttgaacttcgcattaggtttacaaactgtaaatccaagccaaagatttccatctgtgatttctaaacgtccaggacggtattcaaccccatcaataaaatcctcatcaatgtcaggacgcggaggcatactcaggaattcattaacttctaaaacatggtcttttattttgtggaataattcaaaaacatatgtctcatcaatctcccgttgaattgcacgatcaagaagatgctgagaatattttagatgaaacgatgagacccctgctgcttttgatgcctcacgaatctcattgttaatttgacgaaactccgactcaaagtgacgacgaagcttatttcgacggataaaaacttctgtattgatagtcatgttgttctcctcttaactgatagaaaaattataccacagtcaagaggaaaagtaaacagttattctttaaatctaatcaatttattcatagactttgaaacttctgcacgaacctcatgtagatttttgagctgttcaagacgctgctcatagtaagcaatttcatcttcttcgagacagtcctgtgaatcttctttaagataccgtgcatagtcctggaaagcgttacggactacttcctggaagtcatcaagactttgaattttcttaggagcagcagacacacgacgaggggcagtataatactcataaccaaaccctgcgcttaattgagccattaatatttttcctctggttggaacacagcacgacaagcccacatactggcttctttgagtttcattttagcaatagctaactgatcgaggctttcagcataattcttcgcgagttcaaagtcttcgcaattatctagtgcttcccagaattcatcatataaagcatcaaagataagtcctaaacgaacttcagcgtctttaatagcatttactttaccgattttttcgtcggtatgtggcttataacctttaatatcttcaatcatatttgacttcctcaccagtacataaatcgtattcaactaaacgaataggttcatgaatgccatatccctgaacagaaatttctgtcgtaggataaattccactaatatcacccatattccacgcttcattaaattgctgttcgcctgaattactaaaccattctgcgaaagcatttaacacatctttagaaccttcaataattatctttgccattacaagctctcagtaaaggtacgagcgataacgtcgcgctgctgttccggagtcagagagttaaagcgaactgcataaccggatacacggatggtcagctgcggatatttttccggatgcttaactgcatcttccagagtttcacggttcatcacgttaacgttcaggtgctgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattagaaaataattttatccaagattgttctttaattaaaaatggctcagaatcatatgccattaaactttgagtaattaatcctttaaatggtccatcaataaattccatggtaaaatatggaattttattcattaatcttgcattaggagcagtgcacaaaactctgcatcctttgaatacacctttttgtaatttgtattgcttgggataaaattcgctcaagacgttgttatttgccaaaatttcaaaatgattcaccaatttatttttaatagtttttggcgaaaaataaagatattcgaaaagttgcgtatctgtcatcattgcattccaattacgaaaaactgcggacgagtaataccgccaatgcagcatttactattgcagcagtgttgcacagtttcaatatgaatatcgtaaatcttatccatatcaggagatttgacaggctcatcaattatatacaaaattcgcgaaagcgataaacctctgaacttgcttcctttattaccaataaaactgcgtacagaatcagtaaataaacgaaaacgtatatcatcattagaataacgtgaaaattcctttttaatgttatttgcagaaattttagcgtaagctgaagtattagaaagaacaataactgttccgccatcatacaaccaattagcagcaaagttagtcacagcaattgatttaccagattgacgtccaccgtctagtcgaagtgtgcaatactgtttaagcaagtcttcaaatggcaggatatattcgtttttacaaatttcttctactctagcatcagaatggtgtgtaaaagcattcatcagggatagataaggaccagttaaaaatgttctcattttattctctctaaatttgggccattccatggcgcatgaattgtccatttctgtatttacccattaccgcacttgggctcgaccttattacaggttggtgggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaatagctttatagatttttatacgcgtcccaagttccagttctaaacgttgcaatgactcgttttgcgcggttaggtgtttgattataccatctacttttagctaagttaactgttgcttcatcccagcgtttttgctggagcatgcgtaaagaattagtaaatcctgctacgccggtttcccccatttggaagaccatgttaatcaatgcacagcggcgaacagcatcaagagaatcataaactggttttaatttagcatttctcagaattccgcgaacagcagcatcaacatcctgattaaagagtttttcggcctcatcttttgtaattacaccattacaattacgcccaatagctttatctaattcagatttagcaacacttagtgatggacttttagtaagcaaatgaccaatgccaatagtgtaataaccttctgtgtctttatagattttaagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaagtcttctagaaggtctggattataatcgataaaaccagtctcttctgagcattctctttttgcagcttccagtgcattcaaatcagaactttctacacgcccctttggaatatcccagcgatgtgcaatcattccaggtttacgagaaccggtaactcgtcccataaataaatctttatcttctgtcataaagataataccagctgataatgttttcattttaatttcctgcattcagtgataaaattatttaatttttgagcatatttcttttcatcaaaaatcttttgttgtctgcgtaaacgccatggcatttcaatgaacatacgccatattcctgataatactgctgctgtaaaaatattaacaagtatagttaaaagaacccaatctcctattctgtccattggattttttataaaaaagtaaaatacgaacgatgatataggaagactaatgatataccacagaagaaccttcttatctgtgaaccaatcagcattcgttaacttagcgcgaccgttttgaatacatacgaacttatcatctgttacagtaaatggcttagctgcttgatatcccattctaaactccctaattaatcgtttctttgtatcttcagaacagccgctccagtcaactctatcaactgaaatgccatcgtccccatcatctaaatcataccagcgagtttttaaaatcatttaattttcctacaatcactcacaaactcttccattgattctttttcaatataagacatatagctattatattcctttaattgtattttgtaatccttttttctttgccaatttattttaaaattatcataatgaaaatataacatggtaccaaagaatgaaaataatgaaatcgctatagtataacaaagctcactccaaacttctgttatatttactgtgccgtcgatgtttaaaataagacagtcaatcattaatccaataagactacctgcaagagctgcaaatgctgatatggcaagaattaatagtgcctctggaaacgaatatttgactttatttagttttggcttttgcatcgtgattccttaacaaatttcataatttcattaaattcatacgcagcaagtttaagctgatgttcctttttaatctttttacactgagctttccattcgcgtacgcgtttacgataatgtcttccttgataccagtatcctacccaatttacaggtactaataaaaatggaactactaatggaagaattaatactaacagaaatactgcgtctgattcaatatcagtagtaacatctataactattccaataatcattaggattataaatgatacagctgtcacaggacctactaatacatcagtaggaattagctggcgctttaattcatacttcaacggtttacttggaaggtatagtgatggttttgacatattctctacattccttaacaaatttttctagtaataaatcgctttcaaaattgggattttctacgaatttatcaaaaagatcatcaacaatagttaagatattctttttactaagaatacgtttattttcatgcttcgtttcagaatcaactataagagtaaagaaatatttcttgccctgaaattttacagtagtatcaatataaaataaatttgacttttgtaaattacgtttaaaccatgcgtcacttaaactataaacaccgagataatcaaaatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatgcgtttaagagcatttagtaattggtctggaacatcaacctgtctttggaactcttcaaacattgaattgaaatcactttgcattttcattttcattcctatttactccaagtataaggggccgaagccccttatcattatttcagagaattaatgtattcctgaacatcggcagaggtagtttcaaccccagaaatattaccgttaaaggtttcaactcgagcaagggtatcttcaatatcaaccttagtcagtgctgcaatttcaactacatcatcagcagtactaattccaagggcatttgctgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcgtcaaattataggctcataatatctcaatcatgagcctgcgtaaacttatttcatattattgaaatattcttctgcgatttcgtcgttatcatggtaaactttagaagacagtttaacataaccttctgctgtgaacatattaatcacaacttttacagtataccactgaccgtcttcattacccattactgcgtaagtttcaaacatcggatgatcaggaccgataactttaatatcattcactgtacgaccgaaatcttctgaaacgcatttcataaagaagttgaacagttcgccgtaattatccatttcattctccaagttgttttctgtatcagtagttgatagttgtatagtaccatggaagaacagagatgtaaacagttttgtgaaaaaatttttagggaattctagggcagggatgggcaattaaaggataggataatatattataaagggtataaactaaatgatgcctagagaggtccagaaaggcctagataccaaaaagccctatcatttagatagggatttaaaattatttacctagtttacttattatagcttctgcagcagcttttagcttagatgcagtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccacttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtaacagcgttatccgagtgattcaaactaaaaagccccaacctttcggtcggggctaagaatgtcatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttacccgaagcctttgcaaaagcagcgccagtagcaactaaacttttccaggccatactaactgcatttcccgtaaatccttccgctttcatgtcgcgtgcaaactggaatcgcgattcatcagaagcatctttataggaatatttacccgcggcaatggcagcttttgcaacagcttgaatttcggtgctagatgcttcatttaacaccgcttcatttaaaaattgagtatatgatttcatcttatttcctgttttaatttgtagatttaatatactaatatttataccaaaaagccccaacctttcggtcggggctaagccttgcggcaaccttgtcggggttccacctgctaaggcaagtgtttgtacgaaacgccgggattcgaacccggttattaagtagttgacgctactcaatatttttaaaaggccatatctcgaccatatccgaacgttccgtcaaaaacgctactcggcttacggcaaagatatttcctcgaatcgataattcggtgcgccgtttctgctgtgatagtaaagagccagaacacagtaaaactgtgggaggaaactatactccagggaacatcagtccgacgacttaccggtagcgacccggtttcttaatattcttttaaagaatcaatatattcacggcgtttacgccacaaatcaattgcttcatacgcggattcagcatttcgaattagccggcatttatgtaaagacttatgattttgatattgtgtagataacggaattgtatctaaaaggtctttacgatcaaaatattcgtaaccatctaaaccaaatgaacgatttttgagaaattgccaatgaccatattcgttttcgacataaacataatctgcatgctgataaagcaaattaattacacgttcagaaataacagtatcattatgattaaaatagaatgttaaatcatgaactactaaataaacattacctttcatattttcctcacttataattggtcgaggcagtagggatcgaacctacgacctaggacttagaaggtccttgctcttccttctgagctatgccccgtaattggggtgaccgatgggagtcgaacccatgactacgagaatcacaatctcgagttctaccaactgaactacggccacattaatacctactccaacaatcaagatgtcttcacacgaaattaagagaagagtgatcagttcaacccctataatcgcgtcaagtagatattaatgtgacagttgtcacaaatttggcggacgtgataggattcgaacctataaccaatcgcttaacaggcgatcgctctgccattgagctacacatccaaattggtggggagtggtggagtcgaaccacccgagtcgcaatgacaatggatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccgtggcaggatttgaacctacgacattctgctcccaaagcagacgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttggccattctcgcgctgggaataaaggactcgaacctttgcatcctggaatcaaaatccagtgccttaccaacttggctaattcccaattattaacaaaggctcttaagcaagaacccttgatgatagagggtattaatcagtgcgatatgagttaataataacaaataattcttaaagcatatttaccatttataataatacatatttacgatgcattcaagacccaaaggattcttgaaaatatcatattcaagaggacctttttctgtttcaataaagaaatcaaaatttactgtattaaatttacgttcttccttcactaatttaacttgagaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcgattaaatcggtatacccaccacgtggataataattatcacctgcaaacaaaaggaaatttaccttcccggaaggaacatacgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaaaacattttctgccgtagtcaataatccgcatataaatccaacaaacattgaaaaactgaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttgtagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactcttgaataacatatagtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgtccttcgtcatcaaaaacaaacacacctttaattgggcttttaccattaagatagcaaaatgcttgttccataatcgtgattacttctaatttagttagatttaaattagtctcacgatcatagtcaattccttcaaactctttacgagttaagcaaggatagtcggtatttgctgcaaatactccccatgcataagccaatgcatccttaataggaccagcaagttggtatttaactgcagaataattgctcatgataaaatcagcagtagtatcttttccactacgctttacaccgcttaaaaagattagtttcatatgtttctcctcaaatttagttaagattataacacatgaaactgaagcattaaacttccgctataatttttccatctttttctacttgaaaatacgtataaggaatcgttgctgtacatactaaagccgggtctgaatcttctgtgtagctaaattctacttcagacaggtcagaaacccaaggcttataaaaatttattgacatcacgatttcagttttgctattatctaaaatgtaaagcgtaatgtattcaggacctgttttttgggcagtattttcacctgtaagatagttgctagttcctagcatccattcatacattcctatccatgacttaagttcttcatcaactataaatctcacgatgagtggatcgtactcaaatgtagcacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataactgttggtggtataatgggtctaagtcccttccattcaattccatttagaacaaacaacagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccaggtatatatgccttaatcatttggtctgcacccctaaatcctttcacttgactccaatcaatttttaatttcgttttattagtaatagtaggtgtatttgaatattgctttaaaagctcttctaggaattgctggcgagctttaggtggaatatagtgcaagttcaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcgcgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgattcctctttcttcagcaaattgctttccggtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgttaaaattctaaattttattccacgcttttcagctaaagcttgagctgctttccatttgtcagtattaacggaatatgtataaatttcattcataaatcttttcttcgctgcagttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggttgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgtcgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagtgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctggaggttctggcagtaattctaggtcatcttctgatactactgaaccgacaggtcctcctgctccagtaagaaaaactctcgttaaaaattatactaaaactatagttggaaattggagtcgttgggctaataaattaagaagctatgtgtatgagaggtcatagatgtcaggattaagttatgataaatgtgttactgctggtcatgaagcgtggcctccaacagttgtgaatgctacacaaagtaaagtattcactggaggaattgctgttctcgtagcaggtgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacatttgctgaaataaaacaaaacctcattgaatggcttaatggccaaaatgaatttttggattatgattttgaaggctcaagattaaacgttctgtgtgaccttttagcttataatacattgtacattcaacagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattactattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatacgttgatggagcagaatggattaactggacaagaaagtcaatggttcatgctggttctacatcgacaatttactacatgcgtgaaactattgatggaaatactgaattctattttggtgaaggtgaaatttctgttaatgcttctgaaggagctttgaccgctaattatatcggaggtcttaaacctactcagaactctacgattgttattgagtacatcagtactaatggtgctgacgcgaacggagcagtcggattttcatacgcagatacattaacaaatataactgtcatcaatattaatgaaaatccaaacgatgacccagattttgttggggcagatggcggcggtgatccagaagatattgagcgtatccgcgaattgggtactattaaacgcgaaacccagcaacgctgcgtaactgcgactgactatgatacattcgtttcagagagatttggttctattattcaagcagttcagactttcactgattctactaaacctggttatgcatttattgctgctaaacctaaatcaggtctgtatttaactactgtacagcgtgaagatattaaaaattatctcaaagactataatttagctcctattacgccatcaattatttctcctaattatctttttattaagactaatttaaaagtcacatatgctttaaataagctgcaagaatccgaacagtggctcgaaggtcaaataattgataaaattgatcgttattataccgaagacgtagaaatttttaattcatctttcgctaaatctaagatgttgacatatgtagatgatgcagatcattctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgacgttcgcatagtatcaacagaccgagattctaaaggaattggtaaagttattattggtccatttgcttctggcgatgttacagaaaatgaaaacattcagccatatacaggcaacgattttaacaaattagcaaattctgatggacgcgacaaatactatgttatcggtgaaataaattatccagctgatgtgatttattggaatatcgctaaaattaatttaacatctgaaaaatttgaagttcagaccatcgaattatattctgacccaaccgatgatgttatctttactcgcgacggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaaaacgaactcgggggaaaatctcccgagtaatcaatacagatggattaacttaggatatactgcaaataacagcttcttttttgatgatgctgacccattgacatcatacattatcagagtagctacagctgcgcaagattttgagcagtctgattggatttataccgaagagtttgaaacttttgctacaaatgcttatacatttcaaaacatgattgaaatgcaattagccaataaattcattcaggaaaaatttactcttaataattctgattatgttaattttaacaatgacactataatggctgcattgatgaatgaatcatttcaattcagcccatcgtatgttgatgtttcatcaataagtaattttattattggtgaaaatgagtatcatgaaatacaaggttctattcagcaagtatgtaaggatattaaccgagtttatttgatggaatcagaaggaattctatatctttttgagcgctatcaacctgtagttaaagtatccaatgataaaggacaaacctggaaagccgtaaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagcaatgcacctatagattctgatccattatctccaacatattcggaaaggctatttgaatctgatacaatgactataactggaaatcctaaagcagtatgctataaaatggattctattggtgataaagtttttgctcttattatcggtgaagttgaaacattaaatgctaatcctagaacgtcaaaaataattgattctactgataaaggaatatatgttttaaatcatgacacaaaaacgtggaaaagagtttttggcaacactgaagaagaaagaagacgtattcaacctgggtatgcgaatatgtcaactgatggtaaattagtttctctatcttcgagtaattttaaatttttaaatgataacgttgttaatgaccctgaaactgtagcaaaatatcagttaatcggtgccgttaaatatgaatttcctcgtgaatggttagctgataagcattatcatatgatggcatttatagcagatgaaaagtctgattgggaaacttttacgcctcagccaatgaaatactacgcagaaccgttctttaattggtctaaaaaatctaacacacgctgttggataaacaactctaatagagctgtagtagtttatgctgatttaaaatacactaaagttatagaaaatattccggaaacatcaccagatagattagttcatgaatactgggatgatggtgattgtacgatagtaatgccaaatgttaaattcacgggatttaaaaaatatgcgtctgggatgcttttttataaatcttctggtgaaataatttcttattatgattttaactatcgtgtgagagatacagtagaaattatttggaagccgactggagtatttttaaaagcatttttacaaaaccaagagcatgagactccttggtcgccagaagaagagcatggattagctgaccctgatttaagaccattaattggcacaatgatgcctgattcttatttgttgcaggattcgaattttgaggcattttgtgaagcatatattcaatatctttctgacggatacggaactcagtataataatttacgaaatttaattcgtaatcagtatccacgagaagagcatgcgtgggaatatttgtggtcagagatatataaaagaaacatttatttaaatgctgacaaacgtgatgctgttgcaagattttttgaatcacgtagttatgatttttattctactaaaggaattgaagcatcatacaaatttctttttaaagttctttataatgaagaagttgaaattgaaattgaatctggagctggtactgaatatgatataatcgttcaatctgattctttgactgaggatttagtaggacaaacgatttatacagctacaggaagatgtaatgttacttatatagaaagaagttattctaatggtaaattgcaatggaccgtgactatacataatcttttggggcgtttaatagcagggcaagaagttaaagcagaaagactccctagttttgaaggcgaaattattcgtggagttaaaggaaaggatttgcttcaaaacaatatagactatattaatagaagtagatcatactatgtaatgaaaattaaatccaatttaccttcttcccgctggaaatctgacgttattcgttttgttcatccagtaggatttggatttatagcaattacccttttaacgatgtttattaatgttggtttaactcttaaacacacagagacaataattaataaatataaaaactataaatgggattctggattgcctactgaatatgctgatagagtagctaaattaactccaaccggtgaaattgagcatgattcagtaacaggcgaagcaatttatgagcctggcccaatggctggtgtaaaatatcctcttcctgatgactataatgctgaaaatagtaattcaatatttcaaggtcaattgccttctgaacgacgcaagttaatgagtcctctatttgacgcatctggaacaacatttgcacagtttagggatttagttaataaacgtctaaaagataatataggaaatccaagagaccctgaaaatccaacacaggttaaaatagatgaatgattcaagtgttatctatcgtgcgatagttacttcaaaatttagaacagaaaaaatgttgaatttttataattcaattgggagtggtccggataaaaacactatctttatcacatttggaagatcagaaccgtggtcatcaaatgaaaatgaggtgggctttgctccaccttatccaactgattctgtattgggtgtaactgacatgtggactcatatgatgggaaccgtaaaggttcttccatctatgcttgacgcagttattcctcgtcgagattggggagatactagatatccggatccatacacatttagaattaacgatattgtagtgtgtaactcagctccttacaacgctactgaatcaggcgcaggctggttagtatatcgttgtttagatgttcctgatactggaatgtgttcaattgcatctttaactgataaggatgaatgccttaaattaggcggaaaatggacaccttctgttaggtcaatgactcctcctgaaggtcgaggagatgctgaaggaacaattgaacctggggacgggtatgtatgggaatatctttttgagattccacccgatgtatctataaatagatgcacgaatgaatatattgtggttccttggcctgaggaattaaaagaagacccgactagatggggatatgaagataatctcacttggcaacaagatgattttggattaatttaccgggttaaggcaaatactatccgttttaaagcatatttagattcagtttattttcctgatgctgcattgccaggaaataaaggatttagacaaatatcaataatcacgaatcctcttgaagctaaagctcatccaaatgacccaaacgttaaagctgaaaaggattattatgacccagaagatttaatgaggcattcgggcgaaatgatttatatggaaaataggccacctattattatggcaatggatcaaacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcagcgtaaaatggcagtagcaaatggcactggagcagatggtcaaattatccatgctactgggtattatcaaaaacactctattacagagtacgcaactccagtgaaagttggcactagacatgatattgatacctctactgtaggtgttaaagttattattgaaagaggcgaactcggcgattgtgttgaattcattaactctaatggatcaatatcagttactaatcctttaacaattcaagctattgattcaattaaaggtgtttcaggtaatttagtagtaactagcccatatagtaaagtaactttacgctgtatttcatctgataattctacatcggtttggaattattctattgaaagtatgtttggacaaaaggaatcaccagctgaaggtacatggaatatttctacatccggatcagttgatattccactatttcatcgcactgaatacaatatggctaaattgttagttacgtgccaatcggtagatggaagaaaaattaaaacggcagaaataaatattcttgtagatgctgttaattcagaagtcatttcttctgaatatgctgtcatgcgggttggaaatgaaacagaagaagacgaaatcgctaatattgcatttagtattaaagaaaattatgtaacggcaactataagttcttcaactgtcggtatgagagcagcagttaaagttatcgctacgcagaaaatcggggtggctcaataatgaaacaaaatattaatatcggtaatgttgtagatgatggtaccggtgactacctgcgtaaaggtggtataaaaataaatgaaaactttgatgagctttattacgagcttggtgatggagatgttccatattcagccggtgcctggaaaacttataatgcttcatcaggacaaacattaacagcagaatggggaaaatcatatgctattaacacttcatctggaagagtaactctacaacttcctaaaggaaccgttaatgattataataaagtaattaaagctagggatgtatttgcaacatggaatgttaatccagttactctagtagccgcttctggtgatactattaaaggatcatcgtcatcagttgaaattaatgttcaatttagcgatttagagttagtttattgtgctccaggacgttgggaatatgtcaaaaacaaacaaattgacaaaattattagttcagatattagtaatgtagcacgtaaagaatttttagtcgaagttcaaggacaaacagactttttagatgttttccgcggaactagctataatgttaataacatccgagtaaaacaccgtggtaatgaattatattacggcgatgtatttagtgaaaacagtgactttggctctcccggagaaaatgaaggagaattgattcctcttgatggatttaatattaggttaagacagccttgtaatattggtgacactgttcaaattgaaacatttatggatggtgtatcacaatggagaagttcatatacaagacgccaaataaaagtactggattcaaaactaacgtcaaaaacgtctttagaaggaagtatttacgttactgatttatcaacaatgaaatcaattccattttctgcatttggattaattcctggagaacctattaatcctaattctcttgaagttcgttttaatggaattttacaacaacaagctggaacagcaggatatcctctgtttttgtgtgaaggtgctaactcagatacgcaagcaggatgtatatctcttggtggtgaatggaaagaatcgaacacagattattctatagaatatgaagatggaaaacctgtcagtcttttatttgatagaaaatttgaatcaggtgatataatcgttataacatggtttaataatgatttaggaactcttttagaaaaagatgacattattgaattaactgatgaccgttatgttagtaaaggatcatctactgaagttactggggatgtagccttaacagattttgataaaatcggttggccaaatgttgaaaaagttgattcttatactagaacgtataattcaatatcatctattttcgacagcatttatcctgttggttcaatttatgaaaatgctataaacccaaataatccggtgacttatatgggatttggttcatggaaattatttggtaaaggacaagttttagtaggatggaatgatgatgttacagatccaaactttgctttaaacaataatgatttagattctagcggaaatccttcacatactgccggtggaacagttggtacaacatcagtaacgcttgaaaacgcaaatcttcctgcgactaaaactgatgaaagagttttaattgaagacgaaaatggatcagttattattggaggatgtcaatatgacccagacgaaactggtcctatatatacaaaatatcgtgaagactacgcaacaacaaactcttcacatactcctcctactaatattagtaatattcaaccgtctattactgtataccgttggataaggattgcataatgagtttacttaataataaagcgggagttatttcccgcttagcagattttcttggttttagaactaagaaaaatgatatttcggttatgaataatcagccggtaggcgctgtaacaatttcacaaatagcaaaaggtttttatgactcaaatgtagaatctgctatcaatgatgttagaaatatggcagagcaacaggttggagctgtattaattaatataagcggcgtatctcctactggcgtgcaacaaaccgactattggtcatttgaaggaactgttactgatacttcagccaaaccaggtgacccagttattgttaacatgtttggtattccagttaaagctactaatggaatgacttcaattgaatttactagtgctgttagaacagctctacaggaaatggttgtaaaatttattgcaattgattcatttgaagaccatcctaccatagggaataaaatacaagttaagtatttagataaccaagaacatatcttagaacaatactctgataaaggaattactttcaaacaagaaataatttctccttctaaacccgggtatggaacttggcaattattaggtgcgcaaactgttacgctagatagtcacacacaacctacagtattttattattttgagagaatagcatgagtaacaatacatatcagcacgtatcaaatgaatcaaaatatgttaaattcgatcctactggatcgaattttcctggcactgttacgacagtacagtctgcattatcaaaaataagtaatatcggcgtaaatggtattcctgatgcaactatggaagttaaaggaatagcaatgattgcatcagagcaagaggttttagatggaacaaataattctaaaatcgttacaccagctacattagcaacaagattattgtatccaaatgctactgaaactaaatatggtttaacgcgctattcaacaaatgaagaaacattagaaggctcagataataattcatcaataacgccgcaaaaactgaaataccatactgatgatgtgttccgaaatagatattcatctgagtcatcaaacggggttattaaaatatcatctacgcctgcggctttggctggtgttgatgatactacggcgatgactccgctaaaaacccaaaaactcgcaataaaattaatttcacaaatagctccttccgaagatactgcatcagaatctgtgagaggtgtggttcaattatcaactgttgcgcaaactcgtcaaggaactctccgcgaaggatatgcaatttctccgtatacctttatgaattctgttgcaacacaagaatataagggtgttatacgtttaggaacacaatcggaaattaacagtaatttaggagatgttgcagtaacaggtgaaacactaaatggtcgaggagctactggttctatgcgtggagtagttaaattaacgacgcaagccggtattgcccctgaaggtgatagttctggagcattagcgtggaacgcagatgtaattaatacgcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggcgattggaataatcctggcgttcctgatatgcggggtcttttcgtcagaggagctggcacaggcggtcatattttaaatcaacgaggacaagatggttatggaaaggatagacttggcgtaggatgtgacggaatgcatgttggtggtgttcaagcacaacaaatgtcataccataaacacgccggtggttggggggaatataacagaagtgaaggcccatttggcgcgtctgtttatcaaggatatcttggaactagaaaatatgccgactgggataatgcttcatacttcactaatgatggatttgaattaggcggaccgagagatgcccttggtacacttaatcgtgaaggattaattggttatgaaactagaccatggaatatatcattaaactatattattaaagttcattactaaggattacaaatgattgaattaaaagatttaccttttgttgatagcgttcctgatgaaggtcaggaacgtatttcatggattaaaaatggtgaagaaatactaggagctagcactaagtatggaaacgatggatcaatgaatagaccaattgtttccgtgtttaaaaatgttgaggttcttgacgaaaatataggaattcttaaaactgccattgaaacatcgcagaaagatattaaaacaattcaaggagttttagatgtatcaggagatatagaagcactatcgcagatcagtgttaataaaaatgacatatcaaatttaaagacacttactaatgaacacactgatatattaactggaactaataatacagttgacaaaattattgctgatataggtccatttaatgatgaagaaaactctgtttatagaacaattagaaatgatttattgtggattaaacaagaactagggcaatattctggccaagacattaacggtcttcctgttgttggtaatgctagcacaggaatgaaacatagaataataacaaatagtacattattatcttcacaaggcattcgtttaagtgaattagaaaataaatttactgaatctgacgtaggatcattgacggttgaagttggtaaattacgcgatgaacttggtaataaaccagtagattttggaccaaatatttataatagattaaacactatagatgataaacaaactttaataaattctgatatagcagaaattaaatcttctattggatacccagaaaatgtttctataataacagaaattaataataacaaaagtagcattgaatctattaataatgaattaaatcagagtgaaggtgttaaacagcgcttaacggctattgaaacttctataggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctgtaaaaacgaatgaaaccaacattgcggcagtcacacatgaagtaaatacagctaaagacaatatatcctctttacagagcagcgttcaagctctacaagaagcaggttatattcctgaagctccaaaagatggccaagcttacgttcgtaaagacggcgaatgggtactactttctacctttttatcaccagcataacatggggccgcaaggccccaaaggattttaaatgtcaggatataattctcagaatccaaaggaactcaaagatgtcattctaagacgtttaggggctccaattatcaatgttgagttaacacccgatcaaatttatgattgtatccagcgtgccctagaattatacggtgaataccattttgatggacttaacaaaggttttcatgtattttatgtaggagatgacgaagaaaaatataaaaccggagtcttcgatttaagaggttccaacgtatttgcagtaacccgcattttacgcacaaatattgggtcaataacatctatggatggaaatgctacatatccgtggtttactgactttcttttaggaatggctggtattaatggcggaatgggaacgtcttgtaatagattttatggaccaaatgcctttggagctgatttaggatattttactcaacttaccagttatatgggaatgatgcaagatatgctctctcctattccagacttttggtttaattcagcaaatgaacagctcaaagtcatgggaaacttccaaaaatatgatttaattatcgtagaaagctggactaaatcatacattgatactaataaaatggttggaaatacagtaggatatggaacagtcggtccacaagatagctggtcattatctgaacgatataataacccagaccacaatttagttggtcgcgttgttggtcaagattcgaatgttaaacagggtgcttataataatcgttgggtgaaagactacgctacagctttagctaaagaattgaatggtcaaattttagcacgccaccaaggtatgatgcttcctggcggtgttacaatcgatgggcagcgtttaatagaagaagctcgattagaaaaagaagcactgcgcgaagaattatacttacttgaccctccatttggaattttggtaggttaatatggctacttacgataaaaatctttttgctaaattggaaaaccgcacgggttattctcagaccaatgaaactgaaatattaaatccttatgtaaatttcaatcattataaaaacagccaaatattagctgatgtattagtagctgaaagcattcaaatgcgaggtgtagaatgctattatgttccaagagagtatgtttcccctgatttgatatttggcgaagacttaaaaaataaatttactaaagcttggaaatttgctgcatatttaaattcatttgaaggatatgaaggagctaaatcgttctttggtaactttggtatgcaagtacaagacgaagtgactttatctattaacccaaatttatttaagcatcaagttaacggaaaagaaccgaaagaaggcgatttgatatattttcctatggataacagcttatttgaaattaactgggttgaaccatatgatccattttatcaattaggccaaaacgctattcgtaaaattacagcaggtaaattcatttattctggagaagaaattaatccagttctacagaaaaatgaaggaattaacattccagaatttagtgaattagaattaaatcctgttcgcaatcttaatggcattcatgatattaatattgatcagtatgctgaagtagatcaaattaattctgaagctaaagaatatgttgaaccttatgttgttgtcaataatagaggcaaatctttcgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcgataaattcacaagaagatgtagctaaagttgaaactattctacctcgtataaatttgcatttagttgattttagctataacgctccatttaaaacaaacattttaaatcagaatttactgcaaaaaggtacaacttctgtagtatcgcagtataatccatctcctattaaaatgatttatgaattgagtatctttactcgctacgaagatgatatgtttcaaatagttgaacagattcttccatattttcaacctcattttaatacaactatgtacgaacagtttggaaatgatattccatttaaaagggatattaaaattgtactgatgtctgctgctatagacgaatctatagatggagataatttatctcgtcgtagaattgaatggtcattaacatttgaagtaaatggatggatgtatcctccagtagatgatgcagaaggattaattcgtactacttatacagattttcacgccaatacaagagatttgcctgatggcgaaggtgtttttgaatctgtcgataatgaagttgttcctcgagatattaacccagaagactgggatggaacagtaaaacaaactttcactagcaatgtaaatagaccaacaccgccagaacctcctggcccaagaacatagaggttattatggaaggtcttgatataaacaaacttttagatatttctgacctccccggaatcgacggggaggaaattaaagtatatgaacctctacaattagtagaagttaaaagcaatcctcaaaaccgtactcctgacttagaagatgattatggagtagttcgtcgaaatatgcattttcaacaacaaatgctaatggacgcagccaagatttttcttgagacggcaaagaatgctgattctcctcgtcacatggaagtatttgcaactcttatggggcaaatgactacgacgaacagagaaatactgaagcttcataaagatatgaaagatattacatctgagcaggttggcactaaaggcgctgttcctacaggtcaaatgaatattcagaacgcgacagtattcatgggttcaccaacagaattaatggacgaaattggtgatgcttacgaggctcaagaagctcgtgagaaggtgataaatggaacaaccgattaatgcattaaatgatttccatccattaaatgaagctggaaaaattttaataaaacacccaagcttagcagaaagaaaagatgaagatggaattcattggataaaatcacagtgggatggaaaatggtatcctgaaaaattcagtgattatcttcgtttacacaaaatagtaaaaatcccaaataattctgataagcctgaattatttcaaacttataaagataagaataataaaagatctcggtatatgggtcttcctaacttaaaacgagctaatattaaaacacaatggactcgtgaaatggttgaggaatggaaaaaatgccgagatgatattgtatattttgcagaaacatactgcgccattactcatatcgactatggtgtcataaaagttcaattacgtgactatcagcgtgatatgctcaaaataatgtcatctaaacgtatgactgtttgtaatctatcacgtcagcttggtaaaacaactgtagtagctatttttcttgcacactttgtatgttttaacaaggataaagctgtaggtattcttgcgcacaaaggctcaatgtctgcggaagttttagaccgtactaagcaagcaattgaactgcttcctgactttttacagcctggtatagttgaatggaataaagggtctattgaactagataatggttcttcaattggcgcttatgcttcctctcctgacgcagttcgtggtaactcattcgcaatgatttatattgacgaatgtgcatttattccaaacttccatgattcctggcttgctattcaaccagtaatttcatctggtcgtcgttcaaaaattattattactacgactcctaatggattaaatcatttttatgatatttggactgctgctgttgaaggtaaatcaggatttgaaccatacactgctatttggaattcagttaaagaacgtctttataatgatgaagatatttttgacgatggatggcaatggagtatacaaaccattaatggttctactttagctcaatttcgtcaagaacacaccgcagcatttgaagggacttccggtacattaatttcaggaatgaaattagctgttatggatttcattgaagtaactccagatgatcacggttttcatcgatttaaaagccctgaaccagatagaaaatatattgcaactctagactgctcagaaggtcgtgggcaagactatcatgctttacatataattgatgttaccgatgatgtgtgggaacaggttggtgttttgcactcaaacactatttctcatttaattctacctgacatcgttatgcgttatttagtagaatataatgaatgcccagtttatattgaattaaatagtactggtgtgtcagttgctaaatcactttatatggatttagaatacgaaggcgttatttgcgattcatatactgatttaggaatgaagcaaactaaacgaacgaaagcagtcggatgctctacattaaaagaccttattgaaaaagataagcttattattcatcaccgtgcaactattcaagaatttagaacgtttagtgaaaaaggcgtgtcttgggcggctgaagaaggttatcatgacgatttagtaatgtctttagtaatttttggatggttatcaacacaatcaaaatttattgattatgccgacaaagatgacatgcgattagcatctgaagtgttttcaaaagagcttcaagatatgggggatgaatacgctccagttatatttgttgattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaacgaagtagatttagttaatacttttggtcaacctacagctgaaactgctgactattttatgtctgcaatgaatttcttacaatatggaaatgatttgcgagttgtgcgcgctgtcgatagagataccgctaaaaactcatctccgattgctggtaatattgaatacacaatttctaccccaggtagtaactacgcggttggagataaaatcacggtcaaatatgtttcagaagatgttgaaacagaaggtaaaattaccgaagtagatgctgatggaaaaattaagaaaattaatattcctactgcaaaaattattgctaaagctaaagaagttggcgaatacccaacattaggttctaactggactgcagaaatttcttcatcttcttccggtttagctgcagtaataactcttggaaaaattattactgattctggtattttattagctgaaattgaaaatgctgaagctgctatgacagcggttgactttcaagcaaatctcgaaaaatacggaattccaggagtagtagctctttatccaggcgaattaggcgataaaattgaaattgaaatcgtatctaaagctgactatgcaaaaggagcttctgcattactcccaatttatccgggcggtggtactcgtgcatctactgccaaggcagtatttggatatgggccgcagactgactcacagtacgctattatagttcgtcgaaatgatgctattgttcaaagcgttgttctttcaactaagcgtggtgaaaaagatatttacgatagtaacatctatatcgatgactttttcgcaaaaggtggttcagaatatatttttgcaactgcacaaaactggccagaaggcttctctggaattttaactctgtctggtggattatcatcaaatgctgaagtaacagcaggagatttaatggaagcttgggacttctttgctgaccgtgaatctgttgatgttcaactgtttattgcgggttcttgtgccggtgaatctttagaaacagcatctactgtccaaaaacacgtcgtttcaattggggatgctcgccaagattgcttagtattgtgctctcctccgcgtgaaactgtagttggaattcctgtaactcgtgcagtagataatttagttaactggagaactgcggcaggttcatacactgataataactttaatatcagttcaacctatgcagcaatcgacggcaactacaaatatcagtatgacaaatataatgatgtgaatcgttgggttccattagcagctgatattgccggtttatgcgcgagaactgataacgtttctcagacttggatgtctccagctggttataatcgtggtcagattcttaacgttattaaacttgctattgaaactcgccaagctcagcgcgaccgtttatatcaagaagctatcaacccagtaactggtacaggtggtgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccaatacttacagggaattaaagctctcggtggaatttatgaatatcgtgtagtttgcgatacaacaaataacactccgtcagtaattgatagaaatgagtttgttgcaacattctatattcaaccggcgcgcagtataaattatattactttgaatttcgtcgcaactgctactggtgcagatttcgatgagttaactggtcttgctggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagttggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagagcgctattgttcgtcaatatgctcgtgatgctaaaacagtaacaaaagaaattgaaattaaaggtctgtggcctactaacgtgggtgaacttcaattagattgggattcaaacaatgaaatccaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtagataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggtgctgataatactggcaatatggaagatattcgttggtttagacaagctctttacatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccacttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtaccaatgcttgaatctcatgatggaaaagacttaggtttaaaaccgggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccacggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgaacacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgccgcaggtcagacttctggcgcagtaactcagattggcccagctgttatgggtatggtacgtcgtgctattcctaacctgattgctttcgatatttgtggtgttcagccaatgaacagcccgactggccaggtattcgcgctgcgcgcagtatatggtaaagatccaatcgcttccggcgctaaagaagcattccacccaatgtatggtccagatgcaatgttctctggtcagggtgctgctaagaaattcgctgctttgaaagcaagtgatactcttgaagtcggaactatttacactcacttcttccaggaaactggtacagtatatctgcaagctacagcagctaaacaaattgattcaggcgcatctgacgcagacaaattagatgctgaaattaagaaacaaatggaagctggtgtactggtagaaatcgctgaaggtatggctacttctatcgctgaacttcaggaaggtttcaacggttctaccgataacccatggaatgaaatgggcttccgtatcgataaacaagttatcgaagctaaatctcgtcagctgaaagctgcttactctattgaattagcacaagaccttcgcgctgttcacggtatggatgctgatgctgaactgtctggtattctggctaccgaaattatgctggaaatcaaccgcgaagttgttgattggattaactactccgctcaggttggtaaatctggtatgaccctgactccgggttctaaagctggtgtatttgacttccaggacccaatcgatattcgtggtgctcgctgggcaggtgaatcctttaaagctctgttgttccagattgacaaagaagcagttgaaattgctcgtcagactggtcgcggcgaaggtaacttcattatcgcttcccgtaacgtagttaacgttctggcttcagttgataccggcatttcttatgctgcacaaggtctggctactggctttaacactgatactaccaagtcagtatttgctggtgttctgggtggtaaataccgtgtatatatcgaccagtatgctaaacaggattatttcaccgtaggttataaaggtccgaacgaaatggatgctggtatttactatgctccatatgtagctctgactccgctgcgtggttctgatccgaagaacttccaaccggtaatgggattcaaaactcgttacggtatcggtatcaacccatttgcagaatccgctgctcaggctccggcttctcgcatccagagcggtatgccttctattctgaatagccttggtaaaaacgcttacttccgccgtgtatatgttaaaggtatctaatctttgacgatttaagggaccttcgggtccctttagttgtttttatggtataaataaatcatataaactgaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaactggtgctacttacgccggcgaagctggatatgtagaccgagaacaaatcacagaattaacagaagagtctaaattaactctcaataagggcgatttattcaaatataataatatcgtttataaagtattagaagatacaccatttgctgatattgaagaaagcgatttagaattagctcttcagattgcaattgttcttttaaaggttcgtctattttctgacgcagcgtcaacaagcaaatttgaaagctctgatagtgaaattgcggatgctagattccagattaataaatggcaaaccgcagttaaatctcgtaaacttaaaactggtatcacagttgaattagcacaagatttagaagcaaatggattcgatgctcctaatttcttggaagatttgcttgcaactgaaatggcagatgaaatcaataaagatattctgcagtctttgattacagtgtcaaaacgctataaagttacaggaattactgatactggattcatcgatttgagttatgcatctgcacctgaagctggtcgttcattataccgaatggtatgtgaaatggtttcgcatatccaaaaagaatcaacttatacagcaacgttctgtgttgcttcagctcgtgctgctgcgattcttgctgcatcaggttggttaaaacataaaccagaagatgataaatatctttcacaaaatgcctatgggttcttagctaatggtttaccgctttattgcgatactaacagcccattagattatgtaatcgttggtgtagtagaaaatatcggtgaaaaagaaattgttggatcaattttctatgctccgtatacagaaggtcttgacttagatgaccctgaacatgtaggtgcatttaaagttgtagttgacccagaaagtttgcagccatctatcggtttattagttagatatgctttatcagcaaatccttacactgtagcaaaagatgaaaaagaagcaagaataattgatggtggagacatggataaaatggcgggtcgttcagatttgtctgttttattaggtgttaagctaccaaaaattatcattgatgaataaaacaaagggacctttcggtccctttttatttaacttaccaattcaatccaagccggacgaagtacatcttgtaccattttaactaattcctttttaatcaaagaaggattatctgcttgagttagagtaataccttcacgagaagtttcttccaaaatatcttgaacagttagtcccatcacctttccaaaatccttcggaccaatttcaccaattttagaaataacgttatttactcggttcagtgtaacgtagcaagctaaaattcccaccaatttgttatcagcttctgatagttcaactttagctttaataggcttatcagactttttcttttcactaaatttggaattcttgcatttgatggctacacgatttccattatgaagccaagaaggataacaaggtttcaatacatatccttcagcggtaaatacttcgcctttggcttcagctttccaaacacatttgttagcgtcaactaatccagcatggtctactgtaaaattataatcttggacgacagaatctaaatcatttggcaatttaataagctcttcaaatttaccgcgacctaaaagtggagccattttaaatttaaatgtattacaaaatgattccatcatataatcatcgacataagtcacatcaccactttctgtagtgacaataatgtcaaatacataaaaatctttatcgccataatcgacattcttctgaatgccaggtccagcgaattcgccaaagacttgataagatacaaccgctgaggtttccataatatcttgtactgctttaatagaatcttcgtaattctttagaataatttcatacccaaagaaatcttcagcaggaagaatcggtccagtacgtttagcgcaagttactttatcacgctcaataatcaatgagaaatttgtgccgtgaatcttttcacgagctacccactccccaccagtcaatcccaagctataaagtttttcaataaatttagagttgtaatgattttcaagactgctatactttttaaacataattaatcctcaaaatgtaatttctaaccaatcaccatcacgctgatcactattgactttaaagctgaatccttcttttctcagccaatcaccaatttcttcagtaatcaatttatcacgagcaatacaataataactaaaatgtgttttaccttgttcagctgctttattagcaagttccgaaaaatctttaataaaacactctagcttaaactgtttacttttaagtgctttttcgcgcaattgattagcaaaagattcattttcataaagatcatactgttccatttttcacctttttattgatatgtctttttctatagacgactttttctcgagtttcaaatttatttttagcagtcatagctcgagcccataatacagccacttcttttgcctgtaagtttaattcacgagcaatttcaatgaatgactttccagactcatgaagagtaaacaccacaacctcagttctcataatcaatctcatgttatcgagttggtgccattatatacatcattttctgattgtgttttgtgtgctttcaaaatgaagaaaggggccgaagccccttatgattatggataggtatagatgataccagtttctaaagcagttttatgaatgatgtatccattacgcgattcttgaacatcaacttctggatagtctttaatcatcttctgaagagtgtaacgatgcaggtagtatttactatctgggtcgtcagttttccaatctttaccttcttcggtcattttttggatttcatccataacccaccaaccgcaccagatataagctgaagtacgatgtggaagaggatgaacataaggtagttcaccttctggttcaattggagtccgttcagcaataacaacttcagctgttgaactaattgtctttgaagtgtaattatctttagttaatactgcttcaactttaattgtatgagtacccgctgaggaggtatcaatactataagtattagtagaattactttctgctacgttgtctttcttccaagagtacacaatattagtatcaccaggagcaccagtaacagatgctgttaaagttgcagttccaccaacagtagtattaactgatggcggagataaagaaatggtggcactattaaatgtcgcattattagttactactgttgcttctgctgaaatttcttttgtaacataatttgttgcagaaacagatgcggtgcatttaagagttttacttccgacttcggtcggagtgaatttatacgtagcagaagttgcatccggaatattactgtcatccattgaccattggaatgttatagtagcacctgaaggtgcactagagacatttgcagttaaagtaataggaacaccaaagactgtagtcggagactcgggtgtaatttttagcgtcgaagaattagcctttttatttacagtcaaagaaaccgctgatgattctactgttttatcaacgtaatcagttgcagtcactgtgacagagcaagttatagacttagttccttcagttgttggtgtatattcaaaggttgattgcttttgaccgtcaacatcgaccccgtcaactttccatgtataatcaatagcagcaccaataggttgattgcttacattagcagtgaatgttgttgctgttccaatttctactgccgcaggagaagccggagtaacagtgatagtggaattattttctttcttattaacagtgatagttgttgatgcttcagctatttccggatctcctgcggaaagtgtattagttgcaaccactttaattttttttgttcctgctggagaagcaagagtataatccattgtagcagccgtagagccctgtgttatatcatctacagtccagacgtatgtaatagtaccgtctggggtttcacctgcaggtgtagcagtgaatgtttgtgaacctccaataacccctgtaggagttagaggagataacgtgacagtgaatgccataagttatccttattttaatgttatgaaagaagaattacgagtttcgcgaattagaactgatccatcgcgattaatataataaattaagctaaataatgtttggtgtgctgacgcatgttcaaaactagttgggtgagatttccaatccggagtttcagcaatccattgacaaatccaccaaggaacagtgcagaatcctggattttttccaatcagttgaagattcggactaaagttttccggaagagtaaatacagacggcttttcagattcaataatctcagctacagcttgttcaaacttttcttcaacaaacggagtgtcttcaatcaaaactgaggtattttcaggaattttatccgtttctactacttcaattttaatgtcagatttaaccggagaatcaatcaaaagtgctgcttctggattgacttcttcatcgtcatattttaatccctctgcggcatcagcagcatcaattaagtctttaatagataacccatcagtctccggcataggttcactagcgagcttctggagggcttcttcaatatcaacaacgatattatcaaaagatttattctttttgacctttataccaaactgttcagcatattcagctaatttagctttagcttctttattatcatcaagagccttcagctctgcaatataatctttatctatcataatatttcctcagtataaatatagatatatttattacatggtatttagacatgactgacattaaagtacatttttatgattttagtcacgtgagaattgattgcgaagaaagtacatttcatgaactccgtgatttctttagctttgaagctgatgggtatcgttttaatccgaagtacaaatatggccactgggatggacgaatccgtcttttagattataatcgtcttcttccattcggcttagtcgggcaaattaaaaagttctgtgataactttggctataaagcctggattgacccacagattaacgaaaaagaagaattatcaagaaaagattttgatgaatggctttctaaattagaaatctattcaggaaataaaagaattgaaccgcattggtatcaaaaagatgcagtgttcgaaggattagttaatcgtcgtagaattcttaatcttccaacatccgctggtaaatcgttaattcaagctttgcttgcgcgatattatttggaaaattatgaaggtaaaattcttatcattgttccaacaactgctctaacaactcagatggctgatgacttcgttgactatcgtttattcagtcatgcaatgataaagaaaattggtggcggagcatcaaaagatgataaatataaaaatgatgcaccagtcgttgttggtacatggcaaactgtagtaaaacaaccgaaagaatggttctcacagtttggaatgatgatgaatgatgaatgtcatcttgctacaggaaaaagtatttcatccatcatatcaggtttaaataactgcatgttcaaattcggtttgtctggttcattacgtgatggcaaagccaatatcatgcagtatgttggaatgtttggtgaaatatttaagccagtaacgacttctaagttaatggaagatggacaagtaactgagctaaaaattaatagtatttttcttcgctatcccgatgagttcactactaaattaaagggaaaaacttatcaagaagaaataaaaattattacggggcttagtaaaagaaataaatggatcgctaaattggctattaagcttgcacaaaaagatgaaaacgcttttgtcatgtttaaacatgtatcacatggtaaagctattttcgatttaattaaaaatgaatacgataaagtttattacgtatcaggggaagttgataccgaaacccgcaatataatgaaaaccttagctgaaaatggtaaaggaataattatagtagctagttatggtgtattttctactggtatttcagttaaaaatctgcatcacgttgttttagcgcacggtgttaaatcaaaaatcattgtattacaaacaatcggtcgtgtattacgtaagcatggttctaaaacaatcgcaacagtctgggacctcatagatgactgtggtgtcaagccaaaatctgctaatactaaaaagaaatatgttcacttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgcgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaagaacatcttcaccgcacgggtggtcggccaggatacgaatatcctgacgcttaagattatgctttttcattaagaattgaatttccgtttcaaattcttcttcataattaaaagcatcatcaatgttatatctcattattttccagcctcaaatgctcgcatgtcttgaatatgcttaatagcaaatccacgtgatttaatagcatcaagagctccgctacagaaatctaataaaatcccccaatactgtaacgaggtatcaacctttaaaacatccttatcagctgatagaactgtcttcatttctgatttctcgtaacgatccatactaaattcatcaccatctcctcgtcccgagtagtagtctaatttagctttaagagcaacttttttctgtgcttcaattctaagcatttcctttttaatacttgaatgcttattaagccatttactatataacatcacattattagctgcttcatactgtaatttagtcgaatctataaacacatctttcttcaattcttcttgaagatcttctaatctcatattgttctctattcaattgttattggatggacttagattcattataccacgtttatacgtgaagcattatactctattactggaagccagttgtagttttatctgctcaatatcatcagggttatcgatgactgaaaagcgtatttctactatcaaagtataatcatcataaaccggtattacattaactgctaatttatcaatacgtggctcatagtttcttactgcgctttcgatattacgctcaaccgtgtcagcagtaagaggagtcatattctcaaaaagttggtcagataaatcgcatccaaattcagggtcaaacggtcttgaaccttttcttgttgtaataattcctaaaagactatttttaattgaccttaatccaagtgatcttgaaacgtctttgttccaatccattttcatctctgggtcaatatcagaataaagcttattaatatttgccattacaatagctcaaagaattctttgagtcctcttattacatgagcgtgagtttttccacactctggacatttaattggaacagccaaataaacagtaggctttaaaagcatatcttttatagctacaatatctgactctgtgatgatagaatataaatcttctagttccttttcatttaagtcttcaactggaatgctttccccgttagcatgaatcgtttctatacatgatactatcatgtgggctatatttttatcatcaaaaattttagggtatcggaatttaattttaatgtcacccagtgtataccaaaggtcttctggtgcatctatttgtgtatgtaatagatttatatgggttggtatttcagttccgcaggtgcacttccaggagttttcgtgattaacttctccaagagaatgcgcccataaatgaatcaacaatagttctgattcttggcgatttaaatcttttgcatttgtgcagtctttgattagctttttaacaattacttctacagaaccattatttttggcagtaataagttctagatattctttaagagtaaatgcgcgacagttgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagaacatcggtcaccacaagaacaaaaagaaataattactgatttaattgatgattattttggagactatccgaagacttggcaaccatttatatttttgcaggtatttgtaggttcaataggtaaaactaaagtaccagtcacatttgtatgtccaaaatgtaaaaaagaaaagacagttccatttgaaatatatcaaaaagaattaaaggaacctatttttgatgtagctaatgttaaaattaaattaaattttccttctgagttttatgaaaataaagcaaagatgattactgaaaatattcattctgttcaagtagatgaaatgtggtatgattggaaggaaattagtgaatcgagtcaaatagaacttgttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgagcgcggattcgtattaaaactgattgagaaggataaacaataatgagtatgttgcaacgccccggatatccaaatctcagcgttaaattatttgagagttatgacgcttggagtaataatagatttgttgaattagctgctactattaccacattaactatgcgggattctctttatggtcgaaatgaaggaatgctacaattttatgattctaaaaatatccatacaaaaatggatggaaatgaaataattcagatttctgtagctaatgcaaacgatattaataatgttaaaacaagaatttatggatgtaagcatttttctgtatctgtagattcaaaaggtgataacatcattgctattgaattgggaactattcattctatagaaaatcttaaatttggtagaccatttttccctgatgcaggtgaatctataaaagaaatgcttggtgtcatttatcaagaccgcacattattaactccagcaataaatgctataaatgcttatgttcctgatattccatggactagcacatttgaaaactatttgtcatatgtaagagaagttgctctagcggtaggaagcgataagttcgtatttgtatggcaagacatcatgggagttaacatgatggactatgatatgatgataaatcaagaaccatatccaatgattgtaggtgagccaactttaataggtcaattcgtccaagaattgaaatatccattagcatatgattttgtttggttgactaaatcaaacccgcataaacgtgatccaatgaaaaatgctactatctatgctcattcatttttagattcttcattaccaatgattactacaggaaagggtgaaaactctattgtagtgtcaaggtcaggtgcttattctgaaatgacttatagaaatggatatgaagaagctattcgtcttcagactatggcgcaatatgacggctatgctaaatgttctactgtcggtaattttaacttgactcctggcgttaaaattatttttaatgatagtaaaaaccaatttaaaacagaattttacgttgatgaagttattcacgaattatcaaataataattccgtaactcatctatatatgttcactaatgcaacgaaactggaaacaatcgacccagttaaggttaaaaatgaatttaaaactgatactaccactgaagaaagtagttcttccgataagtaataaagaagtttctattcctaagatgggtcttaaacattataacattttaaaagatgttaaaggtcctgatgaaaatttaaagcttcttattgattctatttgtccaaatttatcaccggcagaagttgatttcgtttctattcatttattggaatttaatggaaagattaaatctcgtaaagaaatagatggctatacttatgacattaatgatgtttatgtatgccaaagattagaatttcaataccaaggaaatacattttattttagacctcctggaaaatttgaacaatttttaacggtgagcgatatgttatctaaatgcttgcttaaggtcaacgatgaagttaaagaaattaattttcttgagatgccagcattcgttttaaaatgggcaaatgatatttttacaactttagcaattcctggccctaatggtccaataactggaattggcaatattattggattatttgaatgaaaaagccacaagaaatgcaaacgatgcgtagaaaagttatttcagataataaaccaacacaggaagcggctaaatccgcttccaatactttatctggacttaatgacatttctacaaaattggatgatgctcaagctgcttctgaattaatagctcaaaccgttgaagaaaaatcgaatgaaataattggagcaattgacaatgtagaaagcgcagtgagtgatactactgctggttctgagttaattgctgaaactgtcgaaattggcaataatattaataaagaaatcggtgaatcgctcggaagtaaattagataaattaacgagtttactcgagcaaaaaatccagacagccggaattcaacaaacaggaactagtttagctacggttgaaagcgctattcctgttaaagttgttgaggacgatacagctgaatccgtgggtcctttattaccagctcctgaagcagttaataatgatcctgacgctgattttttccctgcccctcaaccagttgaacctaagcgagagtcaccggaagaaaaacagaaaaaagaagcatttaatttaaaattatctcaagctttagataaattaacaaagactgttgattttggatttaaaaaatccatttcaattactgataaaatatcaagcatgctatttaagtatactgtcagtgctgctattgaagctgctaaaatggttgcattaataatggctgttgttattggaatagacctactgatggttcattttaaatattggtcagataaattttcaaaagcctgggatttgtttagcactgattttaaaactttttcaagcgaaaccggaacttggggtcctttattacagagcatctttgaatctattgatgaaattaaaaagttctgggaagcgggagattggggcggtttgacggtagctattgtagaagggcttggaaaggttctttataatttaggagaacttattcagcttggaatggctaaattatcagcagcaattcttcgagttattcctggtatgaaagatactgctgacgaagtagaaggaagagcactggaaaatttccaaaattctactggagcatctctcaataaagaagaccaggaaaaagttgcgaattatcaagataaacgaatgaatggagaccttggtccgatagcagaaggactagacaaaattgcgaactggaaaactcgtgcatctaactggattcgtggtgttgataataaagaagcattgacaactgatgaagaacgcgcagcagaagaagaaaaattaaagcagctttcaccagaagaaagaaaaaatgctttaatgaaggctaatgaagcccgtgccgcgatgattcgttttgaaaaatatgctgattcagctgatatgagtaaagactcaacggttaaatcagttgaagctgcctatgaagaccttaaaaaacgaatggatgacccggatttaaataattcaccggcagttaaaaaagaacttgctgctagattttctaaaattgatgctacttatcaagagctcaagaaaaatcagcctaatgccaaacctcaaacttctgctaaatcgccagaagcaaaacaagtccaggtaatagaaaagaacaaagcacagcaagctcctattcaacaagcatctccttcaatcaataatactaataatgttattaagaaaaatactgtcgttcataatatgacacccgtaacgagcacgactgctcctggtgtatttgatgcgactggagttaattaaggaataatatggcaattgttaaagaaataactgctgatttaattaaaaagtccggtgagaaaatttcagccggacagagtactaaatcagaagtagcaactaaaacatacactgcccagtttccaactgggcgtgctagtggtaatgacactacaggggacttccaggtaacagatctatataagaatggattattatttactgcatacaatatgtcatctagggattctggaagtcttagaacgatgagatctaactactcttcttcatcttcgagtattttacgtacagccagaaacactatcagtaatacagtatcaaaactatcaaatggactaatatcagataataattcaggaacaataagtaaagttcctgttgcaaatattcttttacctagatctaaatctgacgtcgatacgtcatcacatagatttaatgatgttcaagatagtcttattacaaaaggtggaggtactgctactggtgtgctaagcaatatggcttcaaccgcagtatttggagcgctggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatctagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgataaaacacctaatggtaactttaacggattagctattgctccaaatctccctagtacatttactctcgagattactatgagagaaattatcacgttaaaccgtgcttctttatatgcgggggctttttaatgtattctttagaggaatttaataatcaagcaataaacgcagatttccaacgtaataatatgttcagctgtgtttttgctacaactccatcaactaaaagctcttcgttgataagttcaattagcaacttttcttataataacttgggcctaaattcagattggttaggattaactcaaggcgatattaatcagggaattactacgctaattacagctggcacacaaaaactgataagaaaatcaggggttagtaaatatcttattggtgccatgagtcaacgtacagttcaaagtttattaggctcatttacagttggtacatatttaattgacttctttaacatggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggctgatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtcatgcaggctggagcagttgatagacaagctgcgcttgaatggcttgaatctgctgctataaatggtattcaaagcgttctcggaaatagtggaggtgttactggactatctaattcgctttcacgacttagtagattagggggaactgcaggaagcatttcaaatattaacactatgacaggaattgtcaattcgcaaagtaaaatattaggagcaatataacaatggggacctttcggtccccatatttttatttacggaatgaaatgaaagcagcaactgaagcaactaaactgtcttcaatataaacttcaatttttaccggagcttctgactcaaatttacctgttactacaccctgaaaaatactttcagtctgttctggctttgaaaaattttcagaaggaaaaattccgaactttttatctgttccaaaaattttgataaattcatcgtaaactgcttcattaaaagcattatcagcaggaataacgccttcaactacaagttcttgacctaaaaagcgtaaagaagatttcattttgtgttcctcatgttatgtaagtaaaattattataacacaacacgagggacttgtaaactacattttgaactttttagacattccgttgatgttaaccaaagaagccaagatttgagaaacttcgttttcctcttcttttgattcttctacaaggaattgattaaatccagccattggacgaacttcaccagtttccattagatggtcgccatcatatactgattcttctaattgttcagaaggaggaacgattgtaccttcgattagatacttgttataagcagtttctttcataaagtaagtacttactttattaatcttcagtaaaattccacgtggtagaataacttcagcttctgacggaaatcctgataaatgacccggaacgataactttgattcgctcagctcctttaattaccatacccacgctagtttcagcatcttcattagcatatgtagaatgactacccatatgcatcaaatcttctgcatcaacggaaccttctccttcaccagaaaatactgcgccggaatcatctagagccatatagtttttaccatgctcaccgaagatatttggtttaagcgatgtggatacgaagttcttgaaatagaacattttattttcaatgttatgacgcaaagttttaaaggtaacttcttgtccacggtaaagtgtagttcctggaggaagaactgaacctttagcgaatgcagaatcaagcgtctcaatatgtttaatagctcgttccatatattcttcacgggtagaatctggtttacccaaaaggaacgagttcatttcaacatatgaatctgcacaataatcttcaattacatcagattcagcttgagttaatccttttggagttacttcagtgcttgcgtattcatatgcctgagcagcagattcattaatcaatttataaatgccattcatgacaaaatgaataatagctgtcttttcatctggcgtagctttagaacctttaaccaaatcattgataattttcttaataacatcaaagctattagaaatattaatatcagcaagatcgcttaaaattttatcagtcttataatcaaagaattctttattctttaaatattcttgagaaccttgatatgttatatcgctctgtaacttgatagatggatcacgtaaacgtgcatgggctaatgcaatatgatttcggaagctttcgagttcataatcactagatttaaaacgagaagcgcttctcataccgcctatagctcctttgctgaagtttgaaccaatttgaataacgccagagttcattggtccttctgctttatacaccggaactttagattcaaactcttgatatttcttagcagcgaagctatcaccctgaagtgaagcatcaacagtagaatattgagcttgtgctgctaatcgacgactaattttagttttctgaataacagcttggtccgtgcgcttatcattttctaaagcaatagaagcagcaacagcaacagctttaggaacagcattacctgttttaacatctacataaacatcaccaacctttgattcaacttttgtgaataactcagttgaaataggaggtacacctggaatgtcttctaaattggcatttttacgataaaccataatatatgcgtactttttatcataatcccagatttcctttaaaagaacatatcgacctgctcctttagtacgtactaaacggtcagcaataacttgcatttgacgagcagcgccatttgttttactctttagtacgcggaataagcatgcatcaattttatactgtttcattgtttgaagagcagtatcaaaaacagcgttaatgacgccaattggatttccacccaagtttctaagtttaaccagtgataatttctcgttgacacctatcattacgatatgcatcattttatcgcccggcttaacgtttttatttgtatcacctccagaggtgtatgtacaaaatctaaatccaggaagcacgctttcttcgccggcttgaatagcaaaaatttgaggtattttatgcttaggatttaagttaacaaccggcgccgaagcgccgtcaaataattctgtaataagttccatgatttatccttgaacgaacttgtaaggcatgtttgtaatatctatgcaagacgcaataattccaagagatgattctactttctgtttaacatttgatgaaacaaatgatgcaaagtcaactctatcttctatatcacctgtcattgtaactacttcgccggtttccattaaacggtcaccgtcataaattactgattcggtgagttcttcggtggtcataacttcagcttgaataagcttgttgttagttttgactgttccatcattgtaagatgcatcagttattttattaactttgaccattaatccacgtggcaaaatgacttccatttcatttgaaggcgctaaacttccaccgggtaaaacaacattgactttatcagccccagtaataacccatccaattccgactaaattatcgctagaattaacaagcccttcatcatttttatcgatagaaatgtttagacgcttttcatctggtaaaacaccaacagctgaatcagtcatccaagtaccaaaaatgtttggatataatgatgttgatacaaaatttctaaaataaaaaactcgattttttaccattgcttcgtatattgaaggtaacattcgttgtgaacgatacaaagtaataccttttggtaatcgttcaccatttttaaaggctgaatctaaattatcaatagctttttctatgtcagatgctgtcaaaatacttgtacgctcatctggattatataatcccaaaagagcattatttatgtctacatatcctgaacctacgtattcacgaattccgcgtttttgtgctggtgtgtatttagatgaatctttattttcgactataggatgtaatgaccatccagctgtaagagcatatccacgtaattctcttcgaataatctttgtttttattgcattccaagaattttgtactaactcatttgcagcatcttggtttaaatgcgaatgtttgttaatatttctttcaaaccaagcacctttatatttttctaaagtatcatcgacgatagaagcaatagtttctaaagtttttattgaagtaatagattcttttcgtaatttttctaaagctttattttttatttctgcattaataatggattctttatcttcaggaattatagaagcttctctgaatgccatcccagctgtaacactgctaagagcattctctagtgcaaatcctgaagtagaaattaccgttaattcattagaatcagaaattaaaggcgcatcagcgggtttatttaattctgctgctgaagcctcaaatttttgaaacatcggtgtttcaaatctagaagattccaatgactgactttgtgcaattgctctacgggaaattttaactttaacgattacagcttggtcagaacgtttatcattttcttgtgcaatagatgctgcaattgcctcatttttggttacttgagctccggtatctttattgatataaacatcaccgaccttcgattcaactttagtaaagagctcggtactaatttccggaactcctggaatgtcttctagtgatacatttttgcgatgtataagaatatatgcatactttttatcataatcccagagttccttaagaaggacgtatctgccacctgaacgactacggataagtctatcagcaataacttgaatttgtcgagcttgaccagcggttttagacttaagaatacgaagcatacaagcatcaattttatactgacgcattgtttgcattgcaacagtaaaaactgaattgatataattaattgggcttggaccaagaccttttaatttagcaattgaacctttagcggttaatgtaaaaggaacaatatgcatcattttatcgcccatttttaaatcgcgattagtatcacctccagatgtataggtacataaacgaaagcctggttgttcaattgcatcatcaacatgaactgaaaaaatttgcggtattttcttctttggatttaagtttgtaatcggaagagtagtatcttcgtcaaataattctgtaataagttccatcatagcctctctagtgtttattctatttataaaattaaaggcccgaaggcctttagtaatctagtggtaagagagtacgatatacttcaaactttggtcctttttcataggcatcaaatgtttctgtaaatttattataagcgtatgcatctacaaattcgagaatgacttgtgatacagaagtagaaacatctccaccttctttttgagcaatgacaattgtttctaagtaagctttcataaaccagttacctcatgaaaatcaccaaatacatcctcgaatgtattagctttagttttatcttcacgtaaacgaatcgcaatcggaagaaataatttaacgtaatcagtgcggccatcagattttaaccaaccgttgcattcgcactctagaatttttccaatataataattttggttttccataatgcgagtacggtcaagttcatgcgattttacaccggctttatcttttaagcctgaaccagcatttaccttaatttttccacactctgattcaagaataaatccacccgctttagtagggtctttacggtgaggataaattcctacaatttttaaatcaacatcaattacttctttaaatttatagagattttttgaacgagcattttcccacaatccatcggtatttttgagaataataccttcaagaccttggtcaatatactttttataaattaccttagcttcatctaggttatttactacctggttttcaattaaaattactttatcataacctgatgtcatttgttctagtttagaaaaacgtacatcatatttcaaacgaaatgcaggaagaccgtatatttctaccaacgggacataatcccagacctgaaacttcatgcattgagcttctttttcagaaatggttccctttaaagatttattggcgatgccattagatgcagtacgtgattcagctacttcggcgaattctttagctttactaatttcaggataagcatcaaaaagaaaatctaggccttctggctccttttcaacttgctcatggtataccaattcgccatcaattaacacaccttctggatgaatctggcgagcttctgcagtcattttgattaactcttccttaagaagatctaatcctagatattcattaccagctcgtgataaaagacgaacatcatctaattcatcacctctgacttcagcaaaacaccgagctccatcagcttttaactgggcaaaggctggaaatttgatattcttattaatgcctttttcatcataagaacttgcaagcatttgaggttgttcaggaattaaacctggccaaactttgtttgcaatagatactgaagcaccgcattcaaggtctcgcatcatcacccgacgcaaaacttcaacatcatcttttttaccgtcagtaatatatccagttaattcctcaattgccgcatttccagtcaatttccgagtagctaacgtgaattcaatgaagtcaagcatatcggtaagagtcaacattccaaaactctgggtagcaatacccggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacataaatgaaaccttgctctacacattttttaaaaattcgttcgtctttttgagctcggaattctggattgcatctaaaaaattgatttacgtgaccgtaatcacgtgtagtattaccttcattttcataaatagtatgaacaacaaacattagaatgctccttggaaaatattatcaccactagtaggtctattatacaaatactctatgccaccaggtttaatatagttccatgtctgaaacggatgtgtctgatatggatgatatagatgattataaggattaaatccaggagttctccaggtagtgttccaaggaaaagaatcgtttttgatcatcttctcaattacatcttttatagctttttcactatcaaaactttctttattttcctttggtgaaaaaagcttattttctacatcattccatgtataaactcgctgtgcagtttttggaatattgtcacgctctcctcgagccatccaataaacaggaacatttaatatttcactcgcgtgatcgcagtggtgagcgagatcgtcaatataacaaattacgttatatttctcttttgcctttttgaacaactcttcttttgaagaatcatgaccacacatcaatacttctgagaaggcaccaggaaaaagagcattcaaattaaattgacgattcagcagagcgtcaatagaatcacccaatgctgtaacagctacaaaattataatcttcttttaatttgttaattacacacagggcatctttatatggagacaagtaacgaataaaatctgaacgattgtatttttcaattaacttgacgccaagttcttcatcacaattaaagagtttaccaggagaaataaatttctcatcttggatcatttttaaaatatgttctaacggaagattatatttctgagcaaaataaggaaggcctgattgccagcttaaacatactccatcaatatcagttaaaatagtaggcttcatagagagtctcttaataggtttaacacatcaataaattcagcttcggttagtattgtatcatcttttgttagaccactagccatgctgtgcttcaaaacttttcctttcgaggcttgtaatgcatcacggaagcccttgttttggatcgctgcttcaaaatatgcatttgtgtataattctttccacgccggggagtatcttgaaaatggaactccaagccagaagagggtcccacggtcctgagctcttgcataagaccttccagcttgttgggcggcaagcccggataacccaaatatacgacgttgttgttcaacatttttcactttgcatccttggaggaatccttcaagacctccaaattgaatgccatccataacgaaaggccaatgggcgaaattacttaatgcacatgatggccacctaaaattgcttctaatctctaactcagacattttcaatgcttataatttcaacatcagcccaatgaccatagcaaggaagacgaaattcaactggccagttagggtccttttctaatataatagactcaacttgcggttcttcatgttcatcagtatacggatttttatctgttactttatatgtgaccttaatgtactgaattccaaaaatcttattaattatattcatactatttcctttaatccgtagataggagataattcatcacccatacgaaggtcttcatttccatctacccagaaaacaatataagcctcttttatttgaataccactccatttaaacggaggtagaaccttagaaattaatccaggtataccaactccctttaattcaacagtttgacctaaaaagaatttcattaaaacctcatctgaaaaccgtgcgatttaacattaccgccattaatatcagaactattaatttcacgtgcaattgagggatcaatgtcaatttcgcgattgagtttagtgatagctaaagtatcgcgcccatttacagtacggaactctaaagggcagactacattaacgtagtttttaatcgattcactggtaggttgcaaatgtgcaggaaggtctttaggcgcctttgagaaaactacttcgcagaagtttttacgggtatcaaaataagtagtcataaacataacattttcctcagtaaggggccaaagcccctcatttattttaaatatcaaattcgttaagaactacatcaaagattgcttcaagatgctcaggtttagctctgttactcagaatatgacgaatccaagttttaaccaaaagcttgcgattaacgccattccagcaaggatgagtccctaaatcgcgttcacggaaatcatcatccagagcgattttaaagttggaaccttccatcgtgattgaaaccgtgataccgttttcaaatcgcatataaacgtaattaggagtcatatactgctcaatttcgcatactgatccattttgatgtttccaaaggcaaatagtatcaatagaacctgcaataccattagaaacatatttacgttcaaagttgatgtagttcattttattctccaagatgtttaattgcggtacaggtatataatatcatatcctgtaccaaagtaaacaattattttactactttccaatgctgcatgtcaagtttaccaacttttttcatcttctcaattaagcgttcggcacgttggcgagctgtaacataataccattcacctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagttttaactgcagcgttcagattaatcgttttcattttattctcctttgtttgtgtaagataatactatcacaaaggaaccatactgtaaacaactttatgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcgacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggttttttgatatttaacgaccaggataaccataaacccgtcatcataccttatagctcttatctgttgcacaccgttagcttaaaggttccgggttcgatttctcgaggataagatatatactgatggatatataggccttgaggcgtactcccgattggccatcacctcggggtagcatgcacttgccgctataagaataacattcaagaggtacaccgtaaaactgccggggtcttaaaactataatgattcgcaaatcattaatcagacagttcgacggctcctcgttttaacttcacactaaggcagtgactctccaataaattacttcagtgttaccacaaagtgacgaactgcttttcgtgcagcagaagccagaggcttagcatatttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaggtaacgaatttttgtttaatttcttttggctgcttaagacccagagctacaaaagggtgtggaacgtttcgaatttgaccaactggaagagaagtcaaatcaccaacttcgcagaaaccttcaggaacatcaggaccgacagagtgaactacacacagttcaggaacttcaccttgaacacgtttaccgataataagtcctgattctgtaacttcttcatcaccggcttgtgcaggttcagaaactaaaataacatattcaccgacagcacgaattggtagctgttgtacttcagacatcgtttttcctttttgttaacagatgaattaataataacaaataattcttaaagcatttatttaccaataaattggagcaaatgctcaactttcataccattaacggaaatcaatttgtcaatagaaaaacctcgccatgcaccaagttcaacatcaaatactggaatcatatcagtagattctttccgagtagattcagtcaatttaccagtttgcatggttggcataaagtcagcatcgcgagtacctttcataacacgaatagtaccatcagacttttcaaaaactacgtttgaaacacccatggacaatttagttttcaaaatttcacgaattgctactttttgttcagtcgtcagtttcatttatttacctattacagttttaatatgagttgttccacgttctttaagagtggaaagtaatttttggcatttttctaaatcagatttccaactatgtggtctatcaatacaaacccagtttgacttataatactgcttccatttagagaaaaaatacttcttatactctacagcaaatgaaatgttctcgttggaataagaactaattgctgtgagctgtaccaaacgaaatttcattattcaccacagaattcgttgatattttcccagtttaacttatttaagtttttcttaggaacattaaacacttcaatacctgcatttcgcagaatatcatcccagccaggtttatttttatcgtatgtttcacaataaaccagctttttaattccagattgagctattgcttttgcacaatctgggcaaggagaaagtgttacatacatagtagcaccttcaattgaagaaccgtttcgtgcagcaaacaaaatcgcatttagttcagcatgaatttcatttttagacgaccattcagagtgcgcgctacgatgttctttcgccaatacaaaacgatcagttgaaccaaacgatacacattcaggcttatgaccttgaatgatagtatgtttaggcttattcagcaaccaaccttgctcagcagcataatcacagcagttcacaccacctgcaggtgaaccattatatccagtagaaataatacgtccattcttttcaattactgctcctactttccaggagcaacattttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcaccagccatctttttgtgaagctcaactggatacttcgtcacaataatagcatcatacacagaaggatgaatactattcactagagtatcgttcattaaagttattctaatgaactgtgctgtttcagagtcaagcgctctatgatcgccagtatcattttcaagacaattatcaattatatcagttaaattcatcatagtacgccatacaccctttgtgcttcaactaatccatcaaaatccaatttgagatgtgttatttggtcaccatcacctggattcacaattactaataccgaacgaggagttttggtaataacacgaaccgacgtttcaggaaatcgttcagaaaccttatttaccaattcttgagcaaatagtttaactttttcttggaattctttaacagtaattggtttttcgcttagcatgttgatcctagctccttactttcaacatttttaactaatttgacagaaactaattcagcatcttgggtaatcattaccggaccttcttcatgctcttcaagatattctagagctttctttttagcttcttccttcgtatcagtttgagcatagatatagaacatacaaccagtaatacctactactttccacttaatttctttatcagttttaatttcaaatttacttacagaatcatctttttgaacttcttcgaaaaaagaatattctaacatataagcaattgaaaataacgggctaactttataggattcacccattacatcaacagctttataccaacaatcatcaatttcacgtttaatgctaataacatttttcgcaggatctatttttactttaaatgaattttccccaataaactgggcaattcgtttattagccccgcaagtttcattaaaaatatctttatatccagctttaaagcgataaaccttatcttcttcaaaccattcgctcatttcaatttcctcatttgttttggtagagctataatatcacaactctaccgtaaagtaaactattaaattgctttgaattctgatgtctgtgattcaaagcgaatgtcgcctttgataactagctcagcatcaagaccaaatacaacaatgatatgcgcggaacctggatacaacgtaatggcaatagaatccacctggtctggaagcaaagcgttcaatacatgagtcacttgagcgtggattcgaagttcagctgcattatcaagcttttcaaacatgttattagcgataatttggctaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccaactaaaccgctatttacaataacaaagcccaagtttcatggtgccaagccattaaaaatctcccgaagcgacttgccagcattcaacaccgatgcggcgccacatttcaactacttgagttcggtcatcaatagctaatttcacatcaaaatgcggtgcgatgtgtttccagaaaatttcttctttaactacatcatctttacgggtatcgccttgttcgcgttgacactgcatgactaatggaacaccagcaatgtcctcaacccatttacgggtcatacgataatatttcgttggatcttcttcggttccactttcacggcctgaaacgactacgatttgataacccataagagcatacatcttggatagttcaacgaccattggattaataatatcggtatcgcatttttcaaggtcataaggaccacgaccattcatttttgctaacgtgccatcaacatcaaaaataactgcttttggtttaccaggagtccctttatataccggaagaccgagatactctcgcatgcttttatacattgagcgtaaaacatcaattggtactgctttagttccgcgttttgagttgcgtttaaccaattcagtccaaggaacatcaaacactttatgttcaatttgatgcccaagctctttggcaaactcttcccaaaccttacgtcgttcaggattcagattagtatctgaaacaattacacccttcgttgcgtcttggcagagaatcatgttagcaacatcatgctgcatgtaagttacgataccttctttatttttggtatacttgtactcatcgcgttcttcatgtgccataatagattggcgatagtcatcacgattgatattataaaaccctggatttttagcaataaattcacgagcccaagtactcttaccagaaccaggacagccaatagtcaaaataatctttttcatcatttaattcctaagaaaacttcaagaatacgaatattgtgctcacgccgtcctttgtacaattcagctgttgattgattcgctgatttactctgaacattggatgaaataaattttatcatgtgatttttaagctgatacatatcaagcccacgagctttcgcttcttttcgcagggctttaccagcatcatctaaagctttagcagggtcttcatcatttaatactattccacgatccaaatccatgtatactgcaccatgacatgcatcaatgtaaaggtctgagcattcaatataacgttctagcagagttttcatttatttttctcaactaatgattgaatataatcatgcaagtctttagatgctttaccccacttattttgatattcatttttgagattagcacgtgattgagctaataaaacatcattagttggaggtaaagattctaaccgctgaatctggcgtccataaatcattgcagccatctcggattcataaatcaatcctttgagatgttcaaattgatgccatgaaatcatttacatttatcctcttttaactcttgacgataataacatatcatagttttttggtcatgtacatatcgttttacatcattaagccaaatacgaaattcctgggaatcttcaaatggcataccgacccaagctttaccatcaataactttaacttgccaagatagtttagcttcatcatatgactttatctgtacaggccaattaggatgaactgtttctttctttacttctagaggctttgtcgaacaaccagctagaagaccgatagataatattactgctgatagtctaatcatttagaaaggtcctggatgtcttctgcgaacttgttgaaggagttgttgatttgtttttcaaccaatcctggcttacgagccaccacatccgccttctttgcatctttgcgcagtttttcattttcacgctcaatagcagcaatcgcctcacgatttttattattcatcgcatcaatataattatactgaattcgcaaattatttaatgctaaggcgttttcattggctgtttttgtaatttcagtaactgatgtttctaatctttctaccttattttttaaaataatagatgttccgccaaatgctattacaagtaatagcaatccagctgtaaaattacttaattgcataaagttttaataacctctataatatcgtcttgagaaagaccgttaattaaaatatgatgttcagccggagatttagaaattttaaagcatgcctcaacatcttctgccatatccgatgcgctacgatttggattactaattccaagacgatgttttcccgttaaaggattaacgatgatatagcatttacagttgttaatatgaacattaggttgagtctgattaatgaacacatcgcaatcatatttcgcaagctgattttctaaaaagactttcatctcttcaaccgcatcaggaagcatatcacgggcttgctcaagacgacgatttcgatattctttaatggtcgttttccgcttgacttgcttagctaaatctttcttaagatcggtgatatatccaactcgacggtttcctttaaatacagaaatcccatctgtagtatcaccgtatgcttcaacgaccatttcagtagtaatgagctgcaaatccatcataaagtcctcatgttatgtcagtaagactactgtaacacaacacgagggacttgtaaacagcttagtatccttctgggataaattttttataatttttcaaaaaattctgttcgatttcacacataaccttctcttgactatcatacccctggtataagctcatgatgataccgaacaagtgatccattccagcacctttagcaacaccttgtgcttccattgcataagtctttctatctttaccacaatgcttattgtgacagtcaagaactaaaaacagagctcggtctaagtacttcagataagtcgtttcaaacgcctcaatttttctgtatgaatattcatcgtcagcgtacattgctttaagatcatctgatgcaccatcaataatagtcttaaacagtttttctggattgtctaatgagctttttgtactatgaagagacacgtaccagtcagacttaattttaaaatgagaaccatctttcatcacagcaacatagccttcgatgttttctgcatttttagcttcttctacccatttaggactatcgatttcgtatcgttcaactagatacggacgaagaatagcatctttataaatatcatcatatgaaatgtattcacccgtttcgttttcacgaacattcaataaaatgattttcatctcttgataagcaagaacgattctattagttggagcgacgaattcgaagttagcagtaaatccatcttcggctaattctttaagtctgtcgcgcaaccgatggtgattaatattcatcaaaatcccattagccattaaagcctgctcagatttgattgaaccctttgatttgaacagaatttcatcaccatctaaataagttgataccaaagacccatcttcttttgttagaatgtaatcaacatcatttaaatcgatattcatcgtgaatggattttcattcaagttaaaaaacttttccataggacgagaagcgattcttaccggtttttctccatccatttcaaacataattccacgacattctaatgcgtctggaagtaaccaatcagaataagatgcataattatatgagaaaattctgtaagttcttccagatgcacttacatcatctgagtaaaaaaacttacgctgtgaatccttacatagttccattaaattgttaaaaagttcttgcattgtgtatcctcttttgtgttttgaatatagtaccacactccatgtggaagcatcatttcttcttgtgttgaatattccaaggtgggttaaacagcttaatgaatagtggctcctctagatcaatcgttgcgattgtcattgtacctaactcatttgtcatagaaagattaaaacattggcgggcgtaaaattcaactttgcttccttcctttagcgcagcatgaattaatgcagatttagtagaatcagacgttttgtctttacgattaatagcagttctataataatttattcttttacgtaaatttttagtttttccaatataaacaagctcatcatttatagcaatagcataaattacgttatacttgtttggaatagataactgttttatacttccgttgtcgtctaattctagctcagtatatttaataaatgaatattctgttgcaatttctttcataataaaatgggccttgcggcccactccttaaaagtattttttaaaactcatcataactttatcatcaacatcattatcaatctgtgcaacaagataagatgacagttctacttcttgcggcgcggattgaacattatcagaattaagatattcacgaatccaaggatacggatgtttaaccggagcatcggtaattgggcatggaagaccgcactgtttcatacgagatacagttaagtaatcaataaagctccacatgctatttgtatttaatccaggaacatcgccatctttaaataaatgaactgcccaatctttttcttggcggttaacttccatgaaaatatcaactgcttcttgttcacactcttgggcgattttaacccattgatcaccatcagtgccagattgaagttgacgaataatatattgggtgcctttaaggtgaagctgctcatcacgtgcaataaatttcataatcttcgcattaccttccatgatttccatgttcttatggaagttaaaggtacatgcaaaggatacataaaaacgaatagcttccaatgcgttgattacatgcaaacagaggtaaagagatttcattagctcatgcttccaatatgtctcatgctcaatagcatcttcaataacgtcttcgtctgcattaatttctttttggtattcgatatcagctttagcgttttcccaataacgagttttaatcagaacatcatcataataacgtccaatggattcagcacgtttcataatagcttcatctaatacaatctcatcaaatacctttgacggatcagtataaagatttcgcataatatgagtgtatgaacgactgtgaatagtttcactaaaagtccatgtagcaacccatgtatcaagacttgggtctgaaattaatgacataagtacagcagatggcgcacgaccctgaatgctatccaaaagtgattgatacttcaggttattagtaaaaatattttgctggtactgaggaagcttattaaactgtgcagcatccatcattaagtttacttcttcgggacgccagaaaaatgataattgcttttcggttaaatcttcaaaaactttatgacgttgaatatcataacgcgcaataccaagacctgaaccgaagaacataggttcttttaaaacatcaactggatttgtattaaaaactgtgctcataaattttccgcttagttaatagatagtgactcgtccatgagtcaaattatatcataatttacaggatgaacaatcttcagcttttggagtttctatttcataatcatcagtaccagaaccatcgcgggtattatgataatagaaattttttccgccaaaataccaaaaatacaaaaggtcatcaatcattattgacattggaacctttccttttggaaaaatctgcgggtcataatatgtattcgctgaagctgattgacatacccatttcagcataatagctacctgcgtaagataaggtttattacctttcttagctaatttccatgtatagtcgtaaaggtctatgttatgctcaatattgggcacgacttgattaaaggagccctcttttgattctttaacagagactggtccacgtggaggctcgataccgtttgtactgttagaaacttgggaagatgactcacatggcataagtgctgataatgtgctattacggatgccaaagagcttaaggtcttcccgcagcgacgaccagtcacaaacgtattttggagctgcgatttggtcaatctttttattgtaccagtcgataggtaattcgcctcgagaccaacgagtgtctgaataatattcgcaaggtcctttttctttggcgagcttaatggatgctttaatgagtccatactgtagtctctcaaatagttcatgtgttaaatcgttagcatcttcataagaagcaaaattacttgctagccaagctgcatagttagtaacacctacgccaaggtttcgacgttttttagctttttctgcttcaggaactggatatccttggtaatccaaaagattatcaagagcacgaacttggacttctgccaattcattaattttatcttggtcttgccaatcgaagttatctaacacaaatgcagataacgtacacaatccaatttcagcatcaggactattcacatcatttgttggaatagcaatttcacaacacaagttgctctgacgaataggtgccttttcacgaataaacggagtatagttattcgtattatctatgaactgtacataaatccttgctgttcctgagcgttcagtcatgagtaattcaaacagttcacgggctttaatacgctttttacgaatattagggtctttttctgcggcttcgtataattcacggaaacggtcttggtctttaaaataagaataataaagctcgccacccatttcatgcggactgaacaaagtaatgtaatcgttctttccgaatcgttccatcatcaaatcattcagttgaacaccataatccatatgacgaatgcggttttcttctacgcctttgttatttttcaaaacgagaagattttcaacttccaaatgccaaataggataataagcagtagcagcgccgccacgaattccaccctgtgaacatgatttaactgcagtctgaaaatgtttccaaaaaggaataacaccagtatggcgtacttcacccatgccaatcttagaaccttcggcacgaatcataccaacgttaataccaattccagcgcgtttagagatatattcaacaatcgaagcggaagccttattgatagacttcagcgaatcacctgcctcaataacaacacatgaactaaactgtcgagtcggagtacgacaaccagccataataggagttggtaatgaaatctgtcgagtagatactgcttcataaaaacgaataacatgttttaatctatcaacaggttcatcttgatgcaatgccattccaatagtcataaatgcaaactgaggagtttcataaatttgaccagtggttttatctttaactaaatatttttcttttaattgcatcgccccggaataagtaaattccatatcccgctcgtgcttaatttttgattctaaaaatgtaatttcttctgctgaatattttgacaataattcagggtcatatttaccttcatttacacagtaagaaatatggtcaataaatgaacgcggttcatactgcccataaacatgcttacgaagagcgaacattagacaacgtgcagctacatattgataatcaggctcttcaaccgaaatagaattcgcagcagccttaatgacaatagtctgaatatcatcagttgtcattccatcacggagataagatttaatattttcatataattcataaggatctactgatgttccctcagctgcccaagataaaactttaataattttttgtgggtcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccgacatagacggcccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctaactcacttgggttaggaagtgtaaaaagaactacaccagaagtatctttaaatcgtaaaatcataaatcctcacaattaaattaaaattacaccgccatttttcctttcaagacgccgtgggactgataatctttgagaacgaaatctttaggcctgagtttaagaatgtattccaattgttctttagtagaaagatagcggaatttataaggcaatccgcctattaccagttcacaaagctctttaggttcacgacgcaaaatttctttacattgttctacgtgattcatatagatatgagtattaccaccggaaaatatcaaatctcccggaataagattacacatcttagctacaatatgaactaacgtagcatatgatgcaatattaaatggaagcactatgttcagataaggtcgttaatcttaccccggaattatatccagctgcatgtcaccatgcagatcagactatatctccaacttgttaaagcaagttgtctatcgtttcgagtcacttgaccctactccccaaagggatagtcgttaggcatttatgtagaaccaattccatttatcagattttacacgataagtaactaatccagacgaaattttaaaatgtctagctgcatctgctgcacaatcaaaaataaccccatcacatgaaatctttttaatattactaggctttttacctttcatcttttctgatattttagatttagttatgtctgaatgcttatgattaaagaatgaattattttcacctgaacgatttctgcatttactacaagtataagcagaagtttgtatgcgaacaccgcacttacaaaacttatgggtttctggattccaacgcccgtttttacttccgggtttactgtaaagagctttccgaccatcaggtccaagtttaagcatcttagctttaacagtttcagaacgtttcttaataatttcttcttttaatggatgcgtagaacatgtatcaccaaacgttgcatcagcaatattgtatccattaattttagaattaagctctttaatccaaaaattttctcgttcaataatcaaatctttctcatatggaatttcttccaaaatagaacattcaaacacattaccatgtttgttaaaagacctctgaagctttatagaagaatggcatcctttttctaaatctttaaaatgcctcttccatctcttttcaaaatctttagcacttcctacatatactttattgtttaaagtatttttaatctgataaattccgcttttcataaatacctctttaaatatagaagtatttattaaagggcagtcctacaatttagcacgggattgtctactagagaggttccccgtttagatagattacaagtataagtcaccttatactcaggcctcaattaacccaagaaaacatctactgatcgttgataccactgcaaatccaaatagccattacgcacattaaactgatagaacatatgacaaggcggtaatgccatctgcttgagttcagctggattccatgctgaaacaatttgacgcctatcatttggcaattttttaatacgatcaataacttctataatttggtctacaccaccaaaatcacgccactgttttccataaattggaccaagttcaccgctatggtatcctaaatcttttgcttgattttcgtaattttcatcccaaactgttttgccttggattaacgaatcatgttgaattaatcgcaaatcattgacatttgtgcttcccgataaaaaccaaagcagctcagcaatgcaagctttccaggcgagcttcttagttgttactgcaggaaaacctttagttaaatcccagcgtaatttagtaccgaacaaagcaattgttcctgtgcctgttcggtcatcggtttcgtagccattttccaggatatctttaattaaaaattggtattgtttcattagttcatccaagaatatgtagaaggatatttggcaaagttaggcttatatcctaatttaaccatttgttttgctttgcgagtaaatcctaaagaacgctcacctttaagatattgttttggtgtcataggcccttgatgcatctgccgacaaataaaaagggccatagcattaggaacatccttaacttttaatttattgctcatttatatactgattccgtaagggttgttacttcatctattttataccaatgcgtttcaaccatttcacgcttgcttatatcatcaagaaaacttgcatctaattgaaccgttgaattaacacgatgccttttaacgatgcgagaaacaactacttcatccgcataaggtaacgcagcatataacagagcaggcccgccaattacacttactttggaattctgatcaagcatagtctcgaatggtgcattaggacttgaaacttgaatttcgccaccagaaatgtaagttatgtactgttcccaagtaatatagaaatgtgctaaatcgccgtctttagttacaggataatcacgcgcaaggtcacgcactacaatatgactacgaccaggaagtaatgtagataatgactggaacgttttagcacccataatcataattgtaccttcggtacgagctttaaaattctggaggtcctttttaactcgtccccatggtaaaccatcacctaaaccaaatgctaattcattaaagccttcaactgttttagttggagaataagcaaatactaatttaatcattacgcaaaacccctttcaataaaccattcagtggctttatcagcatcaaagaataattcttcgtaagtcttttctttgttttcaaagactgtcacacaaacacgttgacagtctccgcagtattcttctgacatactcaaagcgtcagaaaacatttcattaaactcatttaaatcaggattatgcaatgcgttaaaaattgcataatcgaattcgtcattcataaattcaaaaacaaaaatcatattattttccttaaacagactttttcacaattttccaatcagctttaaactgatcgacgtcagagtgataaatccaaaatcctgcgctttcaccgtcttcataaagcggacacccatcacattcatcttcccatcccatgccacgtaaaaggtgttcagctttttcaacaagttcagaatctttaccgatgatattaaaataccatttacctctaacttctgaatctttgatgctctggcgttgtaatctcattttattctccttagcaagctttaatcaaaagatataaacagaccaacataactgctgccataatataaggtgcgaacattttcttttctccattagttttgatagggtaatagtatcacactactacccttctgtaaactactttttgaaagtttttcgcaaaagttcaatgatttcatctacattgttttcgtcaacaatgcagtgaatttttgttacgccagaaactttgtctttgacttcatcttcttcagaagtcggttctttatactcacgaaaacaatgaaattcatcttcacaaacgttaaagtaaaaatgctttccatttgcgcattcaatgtgttttattactctaaatccatcaacaaagaaagcttctttaacttcaaaccatccaccattttcttgaataattttaactatcgatgaattagaacgtgggcgataattaataaatgtatcaataagtcttggaacaagctcatactttttgccaatatacattacgttttcctcattttaacggggcttgtaatagccccttgataattattgttcaatcaatcccatgtaaaattctgcgtcttcagaatccataccatcacaatattcattagccataaagcgggtgaggtcttcaagaggaccttcaataacgatttgaatactccaaaacttagaatcttgcacgcttgtgatactaagttcaggataacgattacgaataatctcttcaatatattcaaaatcaacgatgtcaatatcaactttagccatattattttcctctttaattatcagcagtattgccgatagttgtatagtaccatggaaggacaaggatgtaaacagttttgtgaaaaaatttttgaaataaaaaaggggacctctagggtccccaattaattagtaatataatctgttaaaggtcattcaaaaggtcatctagatccgtgtcatcagcactagatgaactgccagagcttgagctcataaaatcatcttcagtttttgttttgaagtcatcaacattgaatgcatccaaatcatcagcaactttatcagctttcttagcggcagttgcagcggcaccacccattgcagcagttcccataacttgactgaacttagtgctcagttcttcaaatgatttgaatttatctttagaagtcatttcagaaaggtcaaccatttgttcgaacagttctttctggaaagattcatcgtcaatgtttggaatcgcagattgattcaggaatttagattcgtcgtagttactaaaaccagaaacttgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcgttttctggagcagctgggtcttttacaacaagaatgttagcccagtaagaagttttacgtttaacaagactgtactctttattgtcagtgttgtacaaatcatttttactgatgtactgacatactggacaagaatcgtaatcaccgtaggtagatgagcatgtttcgatataccatttaccatttttcttgaaaccgtgatttacaagaagtgcgaatggtgcttgttcatcatttttagacggaagaaaacgaattactgcttggccgttacccgcattgtcgagtttcagtttccactcgcctttatcttcagaagaaaaaccacctttatttccagccagtttagccatttgcgcagcgagttcagcagtagatttacgtttaaacatttttatttcctttttaatttaattaacagttggtgctatgacgatgtatgacctcatagctggtcagtgagataattataatcttatttataataagcaattaatacttgcaagatttcacagtttcaatgaaaacatttttagctttctgtgaatcaatatttaaaatttttctataagcctttaactttatagaataattattccagactaaattatcagtctgttcatcatgtttatcaattatatttaaaaacgaatcaagcaagataaacgtctcaaacgaaattatgttcgattgaagtagtttaaaaatataacttgattgaacttttggattatattcaaaaatttctttaaaagcagaaacttcaacttttttactgaaatagtaaatgttgcgaatatcttcttcaaacttaaatttaatttgcttcaagcgtccgatatattcacgataaaacacaagtgcatcagcgtcagagatgtcaccaatccaagcatcttggttagctacaagattgctaataaaaattaaagttaattcttttaatttatacttttctgatagcttttggaaaaaatacttatcccttcgcttttgataagcggcatcagacacccgcatgcaccaattatacttaattacatcatactttccattcatatgttgttttatcattaagtataatttataaactgatttaccatcaatgtatctttcaccaccagcaggcatgcggagtttaatcatagtagaaaatctaatgtattagttttttcacaacgaacaacagaaggacgcaaaagattttcgtcgatagcttctgactgaattttttcaattatacccgaaggaataaatttagcaaattgagtttcaggaatagagttttcttctaagaatgctgttgtagcttcaagataactcattccaaactcttctaccattttttcaataataaatccattttcttgacgatcaagaagctttgctatttcatccttttctttcttgattgaaagttctttttctgaaagaccggtctcatcgaccggacgaatgtcatttagagaaaactgtgtcataaagttcaactacctcttcagtttcagcttcaaacacatcacggttatctttatgatacaaagctaatagacgattaaacatcttaccatcaacgccaagttcatctttagcacgaattcgaatatctttaatcagttcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacgattgaagttttcattgaaggggttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttatgcatcggtgaccattgcttaacatttggatatttgtgaagctgtgtaaagtcaccgtccgatgaaatgattaaaatcttatgtccttctaaagagaactttttaacaagaacagcaatgtggtcatctgcttcatacttatcaatatccataacaatgtatggcatataagctttcaattcatctataactttatgactggattcaaaataaccttcccagtcccaagtagattcttctcgtgcttttccacggtttttcttgtaatagtaagcaaaatcacgacgccagtatccagatttcgcgttatcaatacacagcacaattttagtgtatccaagcgtttttgcttttttgacattaaacttaattgagttcaatatcaaatgacgaaccatcgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttgggcagcaacggataatattccaaaacctgctggaaattttaatagaattcgttggaaagcattacgtactgatgctgtatatacaactgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaagtacgttcagttttaatgactcatccaaagtcacagatgatattcatttttaataatcgtttgtggcaaatgtatgttgctgattatagcagagaagctgcgattgttactccatcgactgcgtatcaagcacaatctaatgattttatcgtacgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaagaccgtacatcgattgacggtttcttgatgtttgacgataatgagaaattgtggagattgtttgacggggatagtaaagcacgtttacgcattataacaactaattcaaatattcgtccaaatgaagaagtcatggtatttggcgcgaataatggaacaacccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaacggtgaaactaattatgttccagttttacaacttgcttatatagaagattctgatggaaaatactgggttgtacagcaaaacgttccaactgtagaaagagtagactctttaaatgcttctactagagcaagattaggcgtaattgctttagctacacaagctcaagcaaatgctgatttagaaaattctccgcaaaaagaattggcaattactccagaaacgttagctaatcgtactgctactgaaactcgcagaggtattgcaagaatagcaactactgctcaagtaaatcagaacaccacattctcttttgcagatgaccttatcatcactcctaaaaagctgaatgaaagaactgctacagaaactcgtagaggtgtcgctgaaattgctacgcagcaggaaactaatacaggtactgatgatactacaatcatcactcctaaaaagcttcaagctcgtcaaggttctgaatcattatctggtattgtaacttttgtatctaccgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgctgttgtaacgccagaaacgttacataaaaagacatcaactgatggaagaattggtttaattgaaattgctacgcaaagtgaagttaatacaggaactgattatactcgtgcagtcactcctaaaactttaaatgaccgtagagcaactgaaagtttaagtggtatagctgaaattgctacgcaagttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttaataactcctaaaaagcttttaggtactaaatctaccgaatcgcaagaaggtgttattaaagttgcaactcagtctgaaactgtgactggaacgtcagcaaatactgctgtatctccaaaaaatttaaaatggattgtgcagagtgaaccaacttgggcagcaactactctgataagagggtttgttaaaacttcttctggttcattaacgtttgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgggtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattaacggaaattatggtttcattgttcgcaatgatggatcagtaacgaattttatgcttactgcatcgggtgatcagactggtggatttaatggattacgtcctttagctattaataatgcatctggccaagtaacgattggtgaaagcttaatcattgccaaaggtgctactataaattcaggcggtttgactgttaactcgagaattcgttctcagggcactaaaacatctgatttatacacccgcgctccaacatctgatactgtaggattctggtcaattgatattaacgattcagccacttataaccagttcccgggttattttaaaatggttgaaaaaactaatgaagtgactgggcttccatacttagaacgtggcgaagaagttaaatctcctggtacattgactcagtttggtaacacacttgattcgctttaccaagattggattacttatccaacgaccccagaagcacgtaccactcgctggacgcgtacatggcagaaaactaaaaattcttggtcaagttttgttcaggtatttgatggaggtaaccctcctcaaccttcggatataggagcaatcccatctgataatggaataataggtaatcttactattcgtgatttcttacgaattggtaatgttcgcattattcctgacccagtgaataaaactgttaaatttgaatgggttgaataagaggtattatggaaaaatttatggcagagtttggacaaggatacgtccaaacgccatttttatcggaaagtaattcagtaagatacaaaataagcatagcgggttcttgcccgctttctactgcggggccatatgttaaatttcaggataatcccgttggaaatcaaacatttagtgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtatcatatgctgctttttatacttcttctaaaagagctattgcattagagcatgttaaactaagtaatagaaaaagcacagatgattatcaaactattttagatgttgtatttgatagtttagaagacgtcggagcgacaggatttccaaaaagaacttatgaaagtgtagagcaattcatgtcagcagttggtggaactaataacgaaattgcgcgattgccaacttcagctgctataagtaaactttctgactataatttaattcctggtgatgttctttatcttaaagcacagttatatgctgatgctgatttacttgatcttggaactacaaacatatccattcgtttttatgatgcatcaaatggatatatttcctcgacccaagctgagtttactgggcaagctgggtcttgggaattaaaagaagactatgtagttgttccagaaaacgccgtaggatttacgatatatgcacaaagaactgctcaagcaggtcaaggcggcatgagaaatttaagtttttctgaagtatcaagaaatggcggcatttcaaaacctgccgaatttggcgtcaacggtattcgcgttaattatgtctgtgaatcggctttacctccagatataatggtacttcctacacaagcctcttctaaaactggcaaagtgtttggacaggaatttagagaagtttaaactgagggagccttcgggttccctttttctttataaataatattaaaataaaggggcatataatggctgatttaaaagtaggttcaactgtgggtggatctgtcatttggcatcaaggaaattttccattgaattcagccggtgacgatgtactctacaaatcatttaaaatatattcagaatataataaaccgcaggcagctgataacgatttcgtttctaaagctaatggtggtacttacgccggtccaattactattaattacggggtaaatagttatcttcaattaagtaataatgaaacccccatccgaattcgttctggtggcggcactggtaatactcttgtagttggcggctcttccggtggtattagttttagacctgcaggtagtgaaatcactactggacaaattacgattacgccagaaggtttgacaacatttaccaaagctgtaacggctccatctgtaactgttacatctactccttccgcagcatctgatgttactcgcaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagtaaaactgcaggtcaacgtcctgctgcttcagtattagccgaaggtgaattggctataaacttaaaagataaaacaattttcacaaaagatgactcaggtagtgttatagaattaggtttaaaatatggaggaacaattgatggttctttaactgttaatggaaacataattggaaatttaacaggtaacgctgcaactgcaacgaaattaaaaacagcacgaaaaattaatggtatatcctttgatgggtcaaaagatatcacgctaactccatctgacataaatgtcaatagcacaacgtttataaaaaataacggcgaattacctgttgatgctaatttagatgagtatgggcctgttgaagaatatcttggagtttggtcgaaagcaacttcaaccaacgctcaaccagcaaataaatttccagaagaaaatgctgtaggtgttctagaagtatttgtggccggtcaatttgctggtactcagagatatacaactagatacggaaatgtttatattcgttccttgactgctacatggaacggagtaaacggtccgtggagtgcgtggcgaaatattcaatctggtactcgtccactgtcaacaacgattgatcttaatgatctaggaggcgctgaacaccttggtttgtggcgaaatagttcaaattccattgctacctttgacagaaatttcccagaagaaggatcgtccgctcaaggacttttagaagtatatgaaggtggaaactattctcgcacacagagatatacgaccagatttggtgttgtttatactcgttgtcttgctgctgcgtgggatgcttctgcgcctaaatggggaccttggcaacaagtcggtaatgtcacaccggcgactttctatgacggagatctgaatgattttaaaactcctgggttatataatattttaggcactgatgccgttattaactgtcctaccggtgaaggtttaccagccgttattgttggtttgctggaagttaaacagcgtgcttctggcggtgctattttccaaaaatttactactgccggaacgggtgcaactactcgcgatcgtatttttgagcgtgcatatactggtggtgtgtggggtgcatggaacgaagtatatacatcttattctctgccaattactttgggtatgggtggtattaaagctcaattagcggagttagattggcaaacctttgattttgtccctggtagtatgtttagtgttcctttgaacaaaataaagaatatgccagcaaatatggattggggcacgattgatggaaacctggttatgttttctgtcggtcctagcgaacataccggaacgggtcgaactgttcaagtgtggcgcggtactgtatctcaggcgaactatcgttatttcgttgttcgtatcgctggtaatccaggaagtaggactaatacttgtcgtcgtgttgttcttgaagacggatcacatacttggactgctcaacaaaactttaggggattgctgaatatcactgctgctgttaatcttggtgctaatcagaaaatttcacttgctccaggagcatatattcaagcccctgctagcggttctggttctaatacttacgcaaatcagaatactaccattgcgccattatatcaggctattgacgattcaaataaaaaccagtttgcgccaattgttaaacagaaaaacactgtaacaaatattactatggcttctggtatggatattgctagttcagaatatcgtatcgttgctcagggtgatttatccgctactggaactacagccactgaattagctacatggcgtttcttgccgtctggccgattcatgtcacaaagccgagtttatgctggcgcagcattcttgaacactgatggtaacattgctggttcaatctggaagaaatacaacgatgcaaccaatttagatgctgccttgaatactcgcctaggtaaaggcggtgatacgatgacaggtcggttaacaatcaatgcacctaatgattctattgtattatcaacaactgctagtaattctttgcatattcgtggtgacgtagacgggagtggtaactggtatattggtaagggtggtgctgataattcgctagcattttatagctatgctactcaggcggcagtacatatcacaaacaatggtgagatttcgctaaatccacaaaatatcgcaatggttaacgttaaccgcgatcgtgtacacattaacggttctggatggattgctagacaaccgggtgattggggcaaccaatggcgagtagaagctccattattcgtcgatcatggttatgtttcacaggattgttattatccaattattaaaggaaaaagtgtaatcaccaatcaagggtttgtaactgccgtcgatcttggtattcgtcgtgtccctaacaattgggggcaagcaattattcgtgttggatctgcagaggcatcgccagcggctggacaccctaacgcggtatttgaatttcattacgacggtactttctattctcctggtaatggtaactttaacgatggcatcgccagcggctggacaccctaacgcggtatttgaatttcattacgacggtactttctattctcctggtaatggtaactttaacgatgtgtatattcgttccgatggtcgtcttaagattaataaaaaagagctagaaaacggagcacttgaaaaagtatgtcgactgaaagtttatatttacgataaagttaagtctattaaagaccgtagtgttattaaacgtgaagttggtattattgctcaggaccttgaaaaggaattaccggaagctgtatctaaagttgaagttgatggatctgatgttctgacaatttctaactctgctgtgaatgctcttttaattaaggctattcaggaaatgagtgaagaaattaaagaattgaaaacgcctctctttactaaaattgctcgcaaaattagtaaatattttaaattctaacaacaagggggaaatgccccctttggagtataaattatggcagtagttggtgttcctggttggattggaagttcagccgcaaatgaaacaggacagcgctggatgagtcaagcggctggtcaattaagattgggtgttccttgctggatgagtcaatttgcaggtcgctcacgagaaattattcacacgcttggagcagaccataacttcaatggtcaatggttccgagatagatgttttgaggcaggtagtgcacctatagtgtttaatattacaggtgatttagtatcatattctaaagatgttcctttattcttcatgtacggggatacgcctaatgaatatgttgttcttaatattcatggtggtgttcatatgtggggtcgtggtggtaatggtggatacactcactcgggaggcgacggtaacggtacacaaggcggtcatgttattcaaaatgatatcggtggacggcttcgtatttggaactacggtgttatagctgctggcggtggcggcggtggtggtattgcatatcgtccacactcaggggcaaactggcaagatatcggtggcggtggtggtcgacctttcggtggcgctggcggtggcggttattccggtggtgctgcttcgtatgaaggtccgggtggtggttatgactatggtaacgcacactccggcgcaggtggtaatgctggtgctgctggtcagaatgcatggtctgacggcggtaaagttcttaaagttggtgttggtggtgcgtctggtcatgcagtgtttgggtcttctccaacttggggtgctgttggaacaatttacggaccaagagtataatttgaataaatatccttaaaaggagggtctatggcagcacctagaatatcattttcgccctctgatattctgtttggtgttctagatcgcttgttcaaagataacgctaccgggaaggttcttgcttcccgagtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacgataaccatgtactggtatagaaatgatcatataagtaatgaccgccttgaatcaatatgtgctcaggcggccagaatattaggaagggctaaataattatttgttcgtatacatttctagatatcgatatacaccctcaaaaccctcgttgaattcatcgatgagggttttcttatcttcttgagttaattcagaaacaattttacgaaatgaattctgatttaactttctaccttcatgcgttactccaatctcattaagaaatgcaataaaattagcacgattctcaacaatatcttctctggaaaatttaatcaaaatagacgcaacagtaataatttcacgaactgtatcaatatttttattcattaactataccactcaattagttgactttgttataatatcatcagacgcttgatttgtaaactggtctgtgttattttcttcaaaaattttttctacgaattccttgaacgactcgcgttcctgagctacattatgctcgattaccttttcaagattatgactcattcgaaataatcttcaatttcgtaatcatggacataaatcattatagtttttaatacatcatcaatactttttcctggagctggaattacgtaaaaatatcctgcttttgagaggtctttataagttccaatcaagaaatcattattctcaagatgtaactcttcaactaattcattgacaattgaatggtataggtttggtagaaacttatatagcttttctagaatatcaattttgattgtgtattgaaccacggactgagaatcaataatcatagaccttccccttatgtttctgtttgcgattagattctttaaacgctttcttcttatccttatgaacagaagctttattaaaattatgctttgcgactaaattgttcatagtgctgaattacctctcttaaacatttgcatgtgaatgaaaactttttagctacaccacattcaaatatatgttctcttaaatcacgtgtatcagtatatcccatctcaacaataaaatgccttattagatttttatctttatcattgagagaattaaaataatcagattttgaattaatttccctggccaaattgaatcaccttcagttgacgttttagctcttttatcatctcttcgttcatcgcaatataaagatcgcgtaaagcaggttttatcattccatttattggggaactaaatgggcatacataatcttttcctacgagctttttagtgaattccatatcacaaaactgaaatgcaggttcattagcataaattccccaattggttgacatcattttattggcatattccaatgcttggatttgattagtaattccatcaatttgaaactttttaatattcattagtaaaggtcctcagagtaaagttctttttcactaccaccacgttcaatacgcacttgtccagcgtaagttgcaataatcattgcttcttcacgtgtccagtaattgctatactggtcaataaatccttggtcttcaccacaaacatggtctgatacaagtttatcacttacctggtcaagaacttcagccatatctttagaataatgacgagcaccaggaataaccagagtcccaccatcttttaacttaaagcggttggctgcacacacaattcgacgttgatatttttcattattgttccaatgagctacttgccaacagatttcaggaacctcttctaaaacatcctcttccgtatattcggtgtagtcgccataggcctgtaatttagctgctagactttctggagtttcacgtaataaagccaggtctaataattcaagacgctctttgaaggttttcatttggtttcctcaacacttttaatttttatagcttgtttagaactttcaaagcattgacaatatactcttaccgcatcaaactggttggccgctttaagatggactacaccttcgtcgttataaaattctacgacaattttaaatgttttcatttaaaccatcctttaatacgttgccataaagttttctgttgagctttgttaacaccaattgaacgaataactggttgagattcctgaaattctttataatcagcaaggtaaatttcgtaagctgcatccgtaaatgaacttatcgctgccataaaattattgcgaatacctactggagcatctttactttcacgaataatcatgtatttaccagtcttaatctttacgatagttccaagataagctccatggtaccagatgtcccaaccctcttgagtaggttctacacaacgacgaagttcattgacaatttctaacttgttcattatttattcctcacagttcagatgctacagtgattacagcttcaatgttttctgccgaacgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactgcggtaagtttcaacctttttaagaacaaatccattttcatctaaaagttttaacatgaagtctttatcttcttccatatcagaagtaatttcgcgagctttacgagttgctcgttttttcagtagttccggagcgttttcctgtgcgtataaagttgctgcatttgaaataatatcctgagcttcaccagtaatgattaatccatcaccagatttctccaccaggccttttttaatcaataccccaatattactattaactactgcattacctaaatctggatgcacctcacgaacttctgcggctgtaatgaaatctttcttagcaatggtaattaaaatcgcagcagttttttcattcagaacatcgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcattttttgtatctccgggttgtttgtttcagttcatttatttgatagttgtatagtaccacagtatgctttggttgtaaaccgttttgtgaaaaaatttttgaaataaaaaagggagagcctcggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagcttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatggcgttcttcttcattatcgctcaaagagtattcttttcggaatttaactttgaatccaaaaccatgctcaccacaagcatcatcccatgtaatgaagcctttatcttcaagcgggtctaagattttactcacataagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgcagtacagctttcttgacagaagaaacactatgaggaagaatgtaagttgcataaccagttgcaataccggaaacgccattaagaagaacagtaggaataataggcaaatagaaagcaggcggaatgtgttctttatcttgatgtactggagcatattcagtatctttatatacgttatagaaatttttacttacacgagcaaaaatataacgacttgctgctgccttttggacagtacgagaaccaaagtttccttgaccgtctaacagaggaaagttattattccaagtgttagccatcaaagcacctgcgtcttgcgcagagttttcaccatgatgatatccaaggtccgctacaccgcctgcgatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcacgattattcagttgcataaatttaccatactagtgaatgtagtgccataataacatcagaaatgaaaagcacgacttgaattaatccgaacattattccgtaatataatgctatcaataaaatagcaagggctaatgaatagcccaagattttcttaatcattagtagataacaacacaaatgttaaatatgcacacataccctgagctaaagcttgcgaaaacacactgctggcatcaatacagatagttaaaacacatgctactatccaacaaataaatgaaataactcctaataattttgcgatattcatattttcctcactggcgtccgaagacgcctttagttttaagattattacgatagaactgcatcacgtgttcgttgtggaaattactcattaatatgcctgcaaaacgaatttaaaattatcagccaacatacggttcatttcttcaagtgtttgatactcagaatgatgattacgagtaaacgctaaagctaactgtccttttccaaatcccgtcgtcagaggtttcatcttagaagcaggcagataaaatactgtgtataccatattgttatttgcaatagtacgtgcaagctgagaccgacgttgacgaatatgacttagaactgcactgaatccttgcttagaacgctgattacctacataaaatcgtgcagacacacatggattactaaatggacgaccatctaatttacttactaaaaaataaaatccaggtttagataaaatatctttatgcggagttcccaaaaaccactcaccacccttgattgtaccaataacagtagcgcctgcattattcagatcagtaacagtcatgtatttcatattaatttcctctaaattattttctactccaaggccgcatgaatacacgcggccattaaattaatcgtcgcagtcgacgctcaattcccaaaactcttctacggtataagtttcagtatcattttcaatacagaaacgttcattactgttatttgctaaagtagcattaactgtcattttttcgctagtgctcttaagaggtgaaatacgaattaactgatcaccactatccaagcaaaaaatttcaccaacttttacatctttaaagattttcataattcacctcaaggagtataaaatccaaatgcagttgttgaccatcccatccaatatggaaaatttgcgccaatgtaaaacataagaatataaaaccaaccactcagcaaattcatcattttacaccattccaaattgtttcaaccacggattttaaaccattttgatgaatatccattccgactaccgtcatcaaataaattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaagcgtttaatacatcaatcattaaaacgattgggaatatactcaaagctattagtattataactacattccatatagctttaacaatctttttcattttctgttcctccgtagttgatagggtaatagtaccacggaagaacagtcttgtaaacaacttttttaaaaatattcgtaataaatgtgaataccaatcactactgccgaaacttgtgcaacccaccacgcacaagcaataagtacagaattaaaaattttcataataacctcatcacaaaagtaaatgttaaacaaattactggaatactaattaaccaaacaaaacaccaacataatgaactcatagttcaatctcaacgatttccaagtgtttttgttttattgcctttttaacacaatcatggactaaatatgaccatgaatcattatattctccattaactaatcgttggagatcttcacgtgatgataagtaaggttgatctgattcccattttgataaaaatactgcagtaaaaatatctccttcatctgtagttgaagtcgtaaatgcaataaattcaccggtaattttatgtttagcgtaataaaatttaaatttcatttttactcctccgtagctgatagttgtatagtaccacggtccttgtggtatgtaaactgttttgtgaaaattttttaaatggaaagataccatccattgtagttgctttttcttacaaccttacgaaggtcttctctgtcaccgatgaacttcggagtgtactggatgacacctggatgaatttctttagtgttgaatataattatacagtcagcgacttgatgatttagaatgggccctagatttattccagaaccgtatggatactctccgctgcatcctgttgttacagaaatccaacgtgagccagtttgatgtgtcttaacttctacacgaagcccacagtattttggatgtgctaaaacatcccacgcgtatgtatatggatcatcgacatcttcttgacctttattaacatacccgcttagccaatctgctacaaaaaactctgcgtatacagcaatacgacatctttcaataacttctgctttatcctggttcgggttttgttttaaagagtatcttgcagtatcagcaattttgaccttcatttcactagtcaagtcactgttcgatagggtaaatgtcggaatctgaaatagtctctgtaaacccggattcgttttctgcatttagactttcctttttaccactgagataagcgttatatactttaagagtgccgtaataaattcggtcattttcatctaaagactcgcggtcaagttcatcgagctcctttttatccatgactataacatcattacagtaaagaaacccaagtttttcgtgaccaaactcaaatttattacagtacacaatattagcgtgatgatttccgtgcagtttaatctcttttatgtcggaatcaccgatattcatacaataaatcataatttttccttaaaacaaaagggccgaagccctttattttacttgaattgtgcaattcttttctctagacattcagcataagatttcattgagatgaactgtgaaagtaacagttcttgctcaactgcattaactgttagaaactttgcgctttctaaaaatttgctcagtgcattaattttgagcattaattgatcgtattcttcttttactcgtgcttgataacctaacataattttcctcagttaagggccgaagcccttatttaaattgttcagtaacgtcttcaactacttcgtattggcaggtacgcattttagcatcgttgtaatcaatcggaattgatactacatcacgcggatgtactttaacttttacaactcggctagttgaactgccaaagtgacgaatataagatttagaacacacatgcagaccgcgagaacaagtttgtgtatcatcgtcattcacacgagtacgtggcattttaactactttaccagggctgttatcaaaagtatttgaatgacagtcaaagtaattactgcgaactactttccaagcatagaagtaaccgtcttctgtaatttcaatatcgtttgctaccaagaaatcaaagagtcgagataccgctttttggcttgggttttccaacagattttccaagaacggaaaatagaattcaaagttttcgcctttttccatcgagtcaagaatacgatcaaccaaaccagatcgcaattcaatattttgatagaacaagcttccaccttcaattcgaacatcgccggaaatatatttttcaacagcgcgacgaacattaattttttgtgccgcttcttccaacttatccgctacaagcagattaagaatttcctggaagtttgaatgagtattaggagttgcgttataagttacaccgtcaacagtaattgaaatgaattttttagatgcattccaaataatgtcagatttagcaactggagcaataactgcatcgctattaactttaactgtaatatcaccgctaatagtaactttagagcgtttagcttcttcagcatttttcaaaacacgacggattgtgtcaaccgatacaccttgccaatcagccaattcctgttgggtgtaattaccacttgaatacagcttaacaatttcagcttgttcgtttttggtcaggcatttaatattgtacataattttcctta

SEQ ID NO: 3 - DNA, 167236 bp, Artificial sequence
  Synthetic polynucleotide
  misc_feature: Ec35, E. coli bacteriophage
ttaggccgcaagggccttcatagttttagcgatttgggaaacttcatcatcacttaaagagttgcgatatccgatgaagtcggaaacaatacggaatttcttggtaaactcagcaaccattttatcactgttttttgaagcattatttgataatacatcaaaaagattagttactgtccagatgtcatgaccgatggtatcttttccaccattaaaatatacaccacgcaatgaactaactatattagcgagtcgtgtatattcttcagaaacttcatctgtactgaagtacttcatcataaaatctagttcaggatacttgataattttatcaatatatcgttgagctgaacttgaataacctacgtacttatcataatctacatcatcaaaagcatctacatataaatcacgtaaagcttcaaaaatacattggcactgaccgagttcttttacctttttctgtaaaagcggacgaataacataaaattcattaatgccaataagattagccatacgaatcaaaatattcatagatggatgacaaagtgatgtagtaccatccatagagaaaatatcagaacgatgcatatacgctacataaccagtaatttcatctgcttctgacgtaagtgtaaataattcctctttttcccaacgcccatctttaatttcaaacttaaatgctgtagcagctttaggacgaggagctttacttttaactacctttggaatataactttttactaaagcttcaatttctgacaaataatgaatgttaacttcatcactttcaaacattgccataatatcaggtagtaaatcaatctgcgattctacttccggattaataaacagaagacgctcattgtgatgaatatttaaagtgttattaaattcactatcatctaacgcatgtgctaatccacggacaatattaacacgatttttaatattatcaataacgatattaatttttgttgtattaataccaaacagacgataacttgacgcaacggctgatgtttcatgactttgcttaatgcgcttcagtcgagggtcaagatttacttcatacaccacgcctgcattacataacttactgtcaggttcaaacatactctgcatctttttatatgacagatttttagtcgtgaatttgactgaattactaatcatataatctcgagcagaataccccatcttcatcaattcacgatatgtgtgacggggagatgtagattctttaaatcgttttacatcttcattaaatgctttctcactaagctctttaactcgttcaataatatttttacgagtgcgatcatccaatgaaagagcttcacgtgatggagcaatatcaagtgaacccattggaaacttaatgtaattcacttcattgcgaatgcttagccagttacggtctctaataacaccatcgataggataaacaataccgccatagatagcatataatccaccacgatctggccagtatctttctggatttacaccgtaataatcatcaaaatccggaaaataatcaatttcacggtcaagaccattaataatagccatatctttgaacggtcgcatgatataagaaacttcataagcaaagtttctaaagtctttttcttcaactggaactacgatttcaataccagttttatcatctggacccatttcttttacgaatgtaggtttaatctgtgggccatcgccatccatgtaagctacataaccacgaatttcacctttatgatacgaagtaatactaaacgtatcagtataactaaacggagatttagaacctaaaccaaatccgccaatgaaatcgttagattcagccttagatgaactgaagtatgaattatacaacccaggagaattatcatcaccttgaatatcaaaatcactcatacccggaccaaaatctcggcaaacaaatcgtggatctaaacgtccaggaacttgtatgataaatttttcaggatttccattaagtgcatgagcatcaatcatgttggtaatcaattcacggactactgcgcgaattttgtttgtatacaaatcagatgacagaattttaaatactttaggagatgctgtgatgctaaatgcttttgatttagaaccattaccaagaattgtttctttttcagtggtgataatcataatttcctcattaattcatattacgcttaataacttcagcaacttctagtagttcatctttagttgcggtgtcggattgaattttatctctaatatccttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactattggctcatccattctttacgaaggtcagcattatctcccatgagcatttcaaaaagctctttccagttctcaggaagtttaacaacatcatatactgggttttgaatcatctcacgatattcagatttttccaaagagccaagtcctttaatataacggatgctatgtttaggtagagcatctttagcactctcatattcagcgactgtataaaaccattcttgttttttaccgacctgagcgatgattacaggagttttgacaaaacgaattcgtccttgctcaaacaattctggccaattactaaaaaatccaagcagagaaggataaatgcttcctaggccatcatggtcagcatcagtcataatagcgatattatgataattcaagttttcagctttttcaccgagaactaatccagtgattgcgcaaatatcaaatagttctttgtttttaagcatatctgcataagacataccccaactgttgagaactttaccgcgcaatggataaccaccgtgaagttctttatcacgaacatcaataagatatccgatagccgaatcaccctcagtcaagaaaagagtagtatcagcatctttaccacaaagattcgctttgatatgtttatgaaccttagctttagaagcctttttagctgctttagtttctgctgctttttctgccgccaatttacgagccaaagcagcttcaataatcggcattaaaattgcttcattatttagaatagcgcgtgaaatctttttagcatcaagttgaatatgactacgaatttcaccaaaaggagaagtaagtcgttctttagtttgagaatcaaatcgcatgtttttcatatcacgaacaaacataacgatagtcaaacattctttaacacgcgctttagtcacatcaattttgaacttacgtttgatttgtggaataaggtcttcacaaatatcatccataacacagtcaatgtgatggccaccattcttagtgtgaatgttattcacataagttaattgacgaaaaccatccggtgaacgaccaaccgcaatagagcaattttcttgttcttgaacgatagcatgctcatcatattggcgtgcatatttcttaaaattgccctgaacctttttaccattaaaggtaaattgaatatcaggataaactactgcaagtgtctggagacgatctagtgtaatgtcaagataaacttgggacagctcattagtttcaaatgacataaaatcaggaatgaaagtaacgcgagttcctttccattttcctggaatagtttcccatgatttattttccatgccatttgaacaacgaactacaatattattttgaccatcaccagtttcaccgacaaacatcacagaaaaaatgtttgtcaaactagaaccaacaccattcataccaccggtgacgcgttctttatcatcaccgaagttaccacctgcttttggaatagtccaggcagcaacaggaccaggaatttcttcaccagtaggtgttttgaccatcgcttgtggaataccgcgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacgaatagttgaatccttaaagaacagcccagaacatactgttccttctactttctgcccggtaggtccaatagcacgaaatccagtatgctggaaatcattttcagagcaaccgaaccagttatatccagtgatttcaatattagtaaacccacttgaagacaaaactttggttgcattatcagcatcagtacatcctactaaagatactgctaatactaatgccgcgatagaacgattaacatatttcataattttcacttaaatttaatggcttgaagaagactaataactctcaagcgacttctttcatctttaactgtaaaagaaagagggtcaccagacttcatagtaatagtgcattcaaaatcaaaatcttcggaaacttctttgaagaagtcaaattcttcatcataaattaaaacttcactccgaagactgtgaagagtttttccgtcatttccagatgctgtactaatcattgtaacattattacctttcatatcttcaacgataaattcgcttgtagatattacagcattaatagaaccattcctataaatagcagaaaatagatatttcttttcttcaccttcgcgaatgcgatatttcttaccgattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccatgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaagggtgcatacctaaacggcgtgcataaattccgttatcagtatggtctttaataaaattttcttgagcttgtttatttttaaattgataccatttattaacttcaaatttaatagccattaataaatttccttccagtaagttgtgccatcttcagtgatttcacgaaatacaccgtaaattggttgtttatccccaaccttttcatacacataaaccgaagtcaagtgagtaaacttagcagtgtgttccttttgaactactaccaaatctggatcgaataatacatcttcaaattcatcattagtgcaattctgaacaattttacgtttcatcataatttcctcattaattgaacattggagcgatgcgtttcagaagagtatcagcgcacctttaacgaattatccattttattcttcaagttgttttctgtatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttctacccattgatcagtaatgtatgcacacatagcgcgagtacgccgaggaagtggttgtccaccttcgataaattcaaactcataaggagcaatgaacttaatagcttgaccgagtttccacttaaagtctacacctacatgcgaagtatcaatcgtttcaattcctttagcgggaacagctttcaaaaacgcagattcaagaaatttcgcgcgaacataaccaaactgaggtttagactttccatctttaggaatgatacgcacttttacttcagaatcttcatctttaacgccgtgtttaagctgaatgcttacaatttcgaccaattttcctgctgctttagaacgggatttatcagatacacgagcaatttcaccaatattaataatcatagttatctctcacttgttaaaaagattttatactccacgggatcattatactctgatcccaagagtttgtaaactagcttacacgaacattaatcactgcgctgcgaggaactacagagtactctccagcatgaactacgttcagaagttcaacaccatcttcaatccactgatcagttacccaaccgccaatcggattcgcgaatggacgacgaatataaactgccttacacaacaaatcagtcgggtcttcaattttttcaactggtgttacatacatagaaactaaatccatatcaatatgggatttttcttgttcttctttttcaatttctgtcaataaattgaaatcttcttcatagatgatgaatgatgatacccttccataatagtttctaatttccatgtacactgtaccaatgagaattccgctattaacactaataacagtaaaaggatatccgccagttgtaccaagaagttcccaaaacttgctatcagtcgtattcgacattgtctggaaatcaatttcagatggttttttcatttgatacgtagtattaattttaatcataattttcctttaatctaaggtaataaagccttttaattcggcatgcgatttgcgaaacattacttgatgcccaccaatgataacttgatcatctggcacttcataaatcgcaatgtacattccacgatcttttaagtcttcacgctcttctcgagtaaaccatctcattatatcatattcactagcgaaagcaaaatgatataatgcaataaaccacaatggaatataattttcaaattgtgaataatctttattccatttagttttaatagcatcattagcattttcaactaataacttatcatcatgtggaataggaatactttcatggctttcataattatcgctatgatgatgaaatgacgatgaattaataccgcaaaattttagccaagttcgagttttcatagaatcaaatccacgataaggagttgattgaacgcataactcttgcctaattttcactataccactatcatcatttaatgcgctaaacgatgattcaacacgataaattttcattttattatcctcagtagctatgctgttataataccacaactaaccgaggaagtaaacaactttttatcgttttgttggaagagacagaggatcgcactcttcctctgacggagcatcttcaagacccatagcatagcgcaaagcgtacttcatcatcaggatgtctttcgcacagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatgtgtcaagttcattctcagaaacaccattaagacgttgaatatcacgaatgagatcgactaaaattggaaaatcaaacgacattccacggcaccagccttgagatttccaaggatcgatattatgtgcattgatgtaatcattaaatttcgcaataccgtcgatagtgcttacatcttcatcggacggtgcaatattttttcgagcttcaggagactgatttttccaccattcgatagtgcttttagtaaaaagacgatgtcctttttggctttttaaatcaaatttgattttaatgccacgtgaaactaattcatcaaatgtttcaactacttctgggttagggtcaaaagcaattacagctaaatcaataacagctgctttttcaccacttcccattgtttcaaaatctataataaaatcaaacattaaattttcctcgctaaatcgcgaatttggcctacagtatagtcttgaatataaactttattaataggttcatcaataaattttgccatagattcaatatctttttgcatctcttcaagactgtatattatctttaaagctttttcgcgaatagtaatattttcaggaccagaatttttctcaatgacagctttaacatttgtcataagagatttaaactgacaccaacttaattcaatcattaataatcgccttataaagatagctaatttcacctaaaacataatcactgattgtgacagttttcacttcaccacaaaagaattctaacgcaattaaatctcgttcaatttcttctaattgaagcatcaacttactagattcaatttttacagtttcacgatttttactataagctatttcataaatttcgctcactttatcttgaagcagataaaactggtctttagttatttccacgaatagcttcctcaaatttaattagtaatttacagacactttcatctattgtaattaccgtatctgtattactgtgatatgattgtttttcaattcgtttaattgctaatatagtatcacttataagataaagcttatgaaggagctcagctcctgttaccataacatcgagattatcttgcttattagtatgcttccttataccatctattagacgatttaaatattttgaattgatgttaatcatatatcctcacacataaaatacgtcataacgaccacgggtaacaccaacataaagaagttgttgagccaattcagcatctgcataatgaatacaaggtgtatagatgaaagcacggtctacagacataccctgcgctttatggaatgttgatgcaggaagtgctttcactttactaaactgtgatttagcatcccaaaaatcactccatggagcttttccacccttattccagtttttataagtttctgctgttttacctaaaaataggttaaacttatatagctcttcatcagatgaaattattttaatcttttcacgataatattcatcatcgccgtaagtttctactgttaaatcccaatgacgaattaagtattctccagaaacaccacgagctttaacaaatgttgatgtatactctgcttctataatacgaactaattgtccgttattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagagatttgacgattgaaaaataatttaccataaaatcgcgtaaagcggtatcaccagtaaatccacgtactccatgcccgtcaacaactttatcataaatccacttaccgttacgaacgtcagtagctacatcaataataggagcattactgcgtttaacttcagtgagttcacactgataaaaatctttatgtgtaaagaatggactgatataagcagtattttctcctggatcaacaggtctaatttgcttattatcacctattccaattatagtacaccaaggtggaatagttgaaagcagaattttaaatagctttctatcatacattgacacttcgtcgcagattaataccctgcatttagctaaatctggtacttccttctgttcaaaaagaacgttttcttcatacgtaactgggttaattttaagaatactgtgaatagtactcgcttctttccccgacagttttgaaagaatctttttagctgcatgtgtaggagctgctaaaataataccagtttcacccgtagatattaaagcttcaatgatgaacttagtaagagtagtcttaccagtaccagcaggtccattaatagttacatgatgtttcttttctttaatagccctcataacgatgttaaaggcatttttctggccttctgtcaaatcatcaaatgtcatcggaaagtccctgcaattggaatactaacaatacgcccagtatctagaattcgttgatataatctttgtgtatctacatcaggcttaacatgtttaacttctattttattaaaccaaaacttgcgtggagtctcaactagtcttggaattcccatacctaaagctagtttatattggtctttgagagtagtaaaaactctatcagcaatctctctttcaaaaaacacagcaggacgatgttcatcaagtggaactggcgccgtaaatccgtctttgtctcggtaaactatcgcatatacataaaccatattatcctcggataagtttaaaaattgaacaatttagcgggtatcctcttttcagtttaagtttatcaataaaagacaaattttgataccgctctacaccttgaataattttatcacacatatcatattgcatttctgcttctgacagctttttcacaattttccaatccgagcctttaagaagaacgttcaatttaacaacttcagcgccttctgctatgcgagaaccatcaatacgtgctttaagtgctataatccttagcttaatgtcagaggtctgttttgatttagaaagctgagaaatgtgttcaattcggttttcacgttttttctgtatagctttaatttgattataagtctttttgattttagcccatttcttttcatctaaatttagtttatgaacttttttcgcagatgaacgaccaattcgcaaagcaaataaatcacgcttttcaatcaactcttctaaagtataatcagaacgaaatgtattatactttttctttactgcaataacattccctttaatgtatccaacgttattatcaaaacgttctaatgataatttctctccttcaatacgattatcaaaaggttctcccgagtaagcacaaactttttgatctaaaatgttcttaatgtaattgaagtctaagttaaaatctttagaacgtctttttgcagatgcctgagtatgctctagacgacgtttaattttacgaatttggttattagacagcttcatatttttctcacatcttacggacggttaactacttatactataacatttttaccttaacttgtaaacaactttatgaaaaatgctttaaaactttcatggtataatgaatctaagtccttccattatagattaaatccttcaaaatcaagagtatagatagtgtatgttgaatactttttatactcgtatctatccgcaattctaaatacacttccagctggtatcattacttcttgttcatctgaaactaattccatattacgatagcgatggctatccggaaacttaaaactcggactatattctttacaacgtaaagcttttatagcatactcctggaaattaaacaccataggagctttgaattcaaaaataacttgtgtgttgtattctaatccagaagcaaaatgtagagctatatttttatcatatgaagctgatactactttatcaaatgtaataatatcaattccttgatttaacacctgtttagtctcaactggaacacctctccaaagaggtttatcgtttggaaccaaacgagatttgactatttcatttaaccaagaatgatcgtctggtttattagtaatacaatgaattaaaagttcaatttcagataaattaaacccttcagaaagtaattcttcacgaatagaagcacgcaccgatgcatccattgattttattttaaaatcttttagttgcattactgagtatttcattcaactacctcaatatcataaactttaaatgttccaaatgaatcgtgtaatttttcttttgaaatagaagttattttatactttccaattggaatcatccattcttgttcacgtacaatcatcattaagttatcagtacgttctgaatctaatccatcagtatcttcatatgtatacttaaattcagtattaggagaagaaagtataatatcgctgatatggtcagagtaattaaaagctttatcagtttttaaacgaagtattgtttcagtgaaatattcagcataagaaaaagaacacgctgtatgcaaactagtagtaaatgaatctaccctgttcgttgaaaacacttctccaacttgtaaatctttaataagttcttttgtcgattttgatataccacgatataattgataaggcgatttagttaaatgctttttaatgattttattcaactgtctgtgaagagcttcattctttttggcttccatacattgccaaagaacagactgctcaaagtcagtaaatttttcacagacttttttatacatatcatattgaaaatcaacgctttcagcttttatagataactgttcaacatctgcaggattaataatcatgatagcctccgtatacttcagaagctatcatatcatcgttagaaaggaaagtaaacaactttttgaattattttgcccagggagcccaaggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatattaattcctagcgataaaaaccaaattgacgattagcttcaataatctttctttcttcttcggacattctccagcgtagtccaacatcaaaatgagcccagaccatcttaacaaatgcatttatatctttaatatcttcaataatgaatgttttacttttagaaggttgactagctaatttaactttatcatcttcaaacaggtcaaaaagactatattcatgagctcttttatagcctttaatagttaaagcttcagaagaagaaaatggtgaatcagtattctgcaaaatatcttcagtatgctttataattagaataacattttctggatattttctttcttttatatctttaattaaaatatccggattttctgctaaaggaataattaatgagcaatttttatcaagtgtatttactgatttaccttctttagacataaattctattgaataatgttttgctacttcaatcatgtgatttccttttgcctactaatggaccgtcaggaattttgttttcctgaatgtatttctcattttcttccatcattttactgccaattttaagaagcaaatccattgcttcatttgctttagctttagcctcttctaacgccatattcttgttcatgatttatccccatagatgtctctcattaatttaagcgctgagcgttctaatttcttttctttctcagcactaatcattgatttcatccattcttctgattcgttctgcatttctttatttgcttgttcaacccaaccatcatcaatatacatcgagtttggtctattgaaccattcaagcatcttcttcagagctttcatttgttttacctaaaacaacagtaggagcatcatcaaattcatgaattttgagcaaatttggatgtaaactattccatacagaagaaataaagtatgataaagcatcttcactcgcaattataaatttatttcctttatctattttccaactatatactgaatcgtacgaataaaaagataaaggtttattattatattgttctgcgctaacattaatgtattctgatttagtaaatgcttcaattgctctaaacggaatatttggtacagtttcaataataccaatctttttaagttttatttcagcatcttctggaactggcattgaaacgaaattttctacgagatacattgggtcacaataacccttatcaatcattactgctacggtaattggaacgtctttagcaaacgacatactattactgctaatatacatttcaaacaaaatcgcttccataattttcctcaatcacaagatgtagatgaacaactagaatcacaagaacttccacatgaatcgcccgtccatacatgaacaggaacattagtatcatatgaatcagaactagactgtgtattctgtgcattagatgatgtagtaggtactgaccagcgccaaggatttttataatattcttgggcttcttcataagtcatagtaactgcttctactgttccatctcccatataaacatattcaactacagttaaaggaaggtagtcatttgaaataggaactacaccttctccgggagttgtagagaaaaaatccgtaaagaaacttttaaaccaattaaagataaacattacaaaaagcctctcttgaattcgacttgcttttcaccataatcatatcgaatctctgcattaaattcgacagaaccatctgcgtacatcataaatgaatgcacaacaacttctgtagaccatggctgtagttcatatttcttcattacatgtcgtgaaatgataatatctaaatcttcatttggtttaatccagcgatttaacatagtgctctcctctataagataattctattataccatactcattttggaaagtaaaccatttaaatgaaaaaaggactcccgaaggagtccttgaatttattcaccagttactttccacaaatcttcatttgcagcaatccattcagtacgttgattttcttcatatactgtagaatatgctgctttttctgaagggaatgtctgataatgagcaccagaaattttgtgaacatcagaataaagagggaaagctacagaaatttcctttccttcaattttcttatttccatctaatttctgctcaaatgttttgatattaacataaccgcgagtactagccatgtaattctccttttatttaaattacatgattatttataataaattctcgcggaacgttaaaatacccaattttagttaatataacaacatcgccgttaataattaccggagaataatcttctggagcattaaatttccaatgggctctaatattatatccatcagaaccaaatgctcgactagccggtctcccggctttttgccatgcataaaaatcaaatttcattttgaatgctctataattaattttaaagcttcttcactgacaaaaatttcgtcaggaccttctataacttcaaccatacgaagttgattagttaagagctcacacacgagctctttgttataatctttaaatagctggtcaatacgtttcttatgggctttcttaagctgacgcttatttaaacgagccattaataacctcggtcttgacgagcgaagttttcagcatttttcagataataaagtttaaagatttcttcagccgacattccaagagcaataaatttattcatgaaaaagtgaaattggtcaatcagttcaaatttaatttcaagctgatcttcgggagataagtcttgaattttcttggattgcatttcagaataacgtttcttccaaggtttccatacagcagaagcttctttttcgccattactcataccgccaagagaagtatataactcgcgggtttcatctgcgatataatcgtcttggtttcgcaaccaagcaagaacttctcctgcagtttcaagtgaatcaggatgacgatttgtttctggtttatcattagccaaacgaatctgtaaatgccgctgcatgtcaagcataacctgcagtgggtcaatattgtgcataatattctcagcatatgcacgatttgctttatcaacaccttcgatcaaatgagcacattcattaaagtgagccattatttttcctttcaattcattaataagttaaataattatatcatttgaatatgtaagcaattaattaaaaatatatacttcatcagttccattcttttctttggaatgatatatgttaaagacgtattttttattaagatgcttaacattatattttttagaccattctttaagaagagtgttttcctttccgtgatgctctaaaacattcgacagtccaaattttattcctctgtcatttaaagaatctaaaagatttaaaaggtctttttcttcttcttctgaccaaaatttattataatcagcaactgttataagatatggaggatctacatatacaaaatcgccgtctagaattttgacatctttaaaatgcaatgaactaaagattattttatcacaattttgcttaaagtgattaaagcgtttttcactatttttgtttatagttctttttccaaacggagtagtaaaatttcctttatcgtttatacgaatcatattactaaacccgtgaaaatgaagaacataaagtaaaagaggatctctagttttattataatcttcacgtaatttcaaaaactcttcttttgatgtttttgatagtttatattgctttattacttttaatacgtcatcccatgatacattaataagacgcttatacatttcaataattggttcttgaatatcattggccaatacaggaccattgacgttcaaagacactgataaacctccacaaaataaatccacgaatctgtcatattttggaaaatgaggcttaagttcaggtaataatgactgtttattacctgtatacgcgatagctcctagcattatattctctcatttattgcagcaaaaaacgaattatataattcttcatcatatgtatttgatagtaatactaacacgttttgtgatttagcatattcattaaaccttgcttggatggttggattatcagtaaatgattctctttttgtccatttattacgtggataatatccgcatggcaaaaaatctaatatcatcaatgacacagggttttcagtttttgtgtattcttttaatttctctttatcttctaaatatattccaaccaaatcaatagctgtacctccaccaacttggtgtttaatttcaattatatgctttttaccgttgcgagaaataacaatatcaaatcttctagtacgcttcttagttataaaattagaacaaaacaaattattttatttttcagtatcatcggttaaaaccattttttcttgataactaactgaacaatcagtgaaatattcttttactttattaagtatgaaattttcaactacggtagatattttatatgaatctccgtttaaagccatttcatgcacaattttattaatcattatatcatcctcagcaatttattttataataccataacaagctgagaaagtaaacaaatttatgataaatattaatttaaaggaggacatatggcacaaaaattaatggcacttgttaatgccataaaaggtaataaaaaacgtatagcttttactatttctgctatggtaggaattttactctggaactttattttatcaccaattgcaattgcgcatggtgttaatattccagtagttactcttgatacattcgtagatctagcatttgctttagttgggttaatttaaatcttggcatatttagataaccgcattttagccattaacccctgggcaatattatttttcatatattccataatttgttcaggggttgcaccttcctttctaatcatatcattaacatcttttgatttccagggagatttatcccaaaacataaccctttctcctgcatcaactaatttagtcattcgcttgatagtgtcagggtgacgaggttcattatctaaaacccacactcgtttatctttaaatggaacaacttctaggtctaattgaccacccgtaatagctataccattttcaataaaaagtgaatctataggtccttctagaacatatacatcaccatctttaactcgttcgactccatatatttttgttgcctcaggataagctttaatggtgatatatttttgaggagcatctttctttaatgcacgtccttgaaaagactcagcttttccattagcattataaattggaataacaagacgaggctcagaaatttcctttttgtatgttcccggtgctatgctattaactaatttaggccattcggttgtaaaccaaagatatttccatttatcctttggaatacaacgagcttttacatattttataattggatggtcttccgccagtttatctaatctaacacatgacggaagagatttaattattttcttctcaggttgcttaggaagttctttaggtttttctactggacgacttttacctttttcttttcttatttcaaagatatactcacgatataaatcaggttcaaactcctttaaatatattccgattggcgcatgatagttacagttataacaatgaatatttccttcattattatcaccataataccatccacgggctttattttggtcggtttttgaatctccacaaactgggcatctaaaccgtaatttaaaagttgaactattatttacttgtgtgaatttaggtaaatgagctaatgcacgatatgcaaactcattatcaatccaaggtattgatgacattctttactcttctttttctttagattcctcttttttctttttaggaatctgttcaggacctttatttactacagcacctgatgttgttccagtagagatattttcaggattaccacctgaatctccagcaaccatatcttctttgataaattctttatatgttttcatattaacctctattcataaaagcattaaaaatttggtcatcaatagatggaatagcaaccttttcggcatcatttagcaaatcattaatttcatcagatagcataacacatgtgcctttatttcctgtaattgttactgcacaattacgaacgttttctttatcaaattttaggttaatattttcgtagtgaaaatcctttaatgccgaatatatctttaaaatgaaattgtcttttactacaataaacccaacctcactattaaaacgtggttcatggaaactgtaataaaccttttcatctataaaatcgtatgaaattttttccatttttaaatatgaaaattcagaactatgcatactaacctctaattactcacctaccacttcagcgatgatatttttgttattaaagtttttatcgcaatacagaacataattatactgcattacaccaccagacttaagttgtttttgcacttcagctttcatttcaggacgatcgcgctcaacaatattcataatatccgcttcaatttgagtttcaacttcagtctgatctgcagtcatagaccattcgcacaagtctttatcatatcctgccatagcaggctgagcagcacaagaagccaaagtaaaaattgtagcaaaaataaattttttcatgataatctcctcagtagtttatgtttatatagtatctcaatttccaacaaaagtaaacagctattttaaaacttctgcataatcacatgttacaaactgtttctctagcttaacgatcttacgaaagtatcttttgcattgacgaatctgccgtttcgtaggacgtacagcaaacttaataaattccactcgaccaaatggagggctttcttctgctggaatatctaacaccaattcccacgtatccgcaataagtgctttgaattgagtatttttcctgacgttatacggagtaggtttaaataaaacaatatgcatattatcctcggcaatctacttcacatactttcttgtcatcaatgaaagctttaactaatgctttattaacttcagcatattgagtagtagcccattgaacgtcatctttcatcattgtgatttctttagtaaacatactttcattcttaaaccaccccataaaaactacctttaccagttccataacaatctcctcatttaaccaacaagactactataccatagtcttgtcagcttgtaaactaaaattttaattcatttgccaaagcatctaactgagctcgagctgattcatttctttgatagcgattctgttcagcctgaatctgttgtgaacctgctacttcactcacttcggttggagtagaatcttgttcaatttctacccatttttgatttcctttttgaacacccatcaaaaacttattccacttattcttatcaccatatcgtgatttgatttgcttaataagttgttgttcagcagctgctagctcctcggtttcaatgaccgcaagcataaaatcagctgttgctggaagaccagcagattctgcgatatcactcatgttaacatcagaagagtcccaagcttgtttaccgacctgtgctgcagtccaaagaacagtttcggtttcaacagccagagcacgcaattcctctgcaatagctttaacagttgtgtaactattttctgaataaactctaatgcgacaagatttacaaatacctagatagtcgacaataatgattgttggaacaaaattcttcttgagcttcaattcgtttaaaagtgatcgaaatgtattagcatctgccccaccagtagggtactgtttaacgattaaacgaccaagagtagatttctcacgccatttttccatttttcctttatactcagcgtaagaaatatgcccatcatcaatgtcatcaagagaaacatcgagcatattagcgtcaatacgtttagcacagacttcttctgccatttccatggaaatgtaaagaacattatgtccaagctgcaaataatctgctgccaatgaacacagacctaatgacttaccaacgttaacgccagccattaaaacgttcagtgttccagtctcagctccacctttagtaattttgttcagaattctgagtttaaatggaaccttacgagctttattcatataagatagccaacgtgcttcgtagtcatccatccaatcatgaccaacgtaactatcaaatgaaattgataatgcctggcgcatgatgtcaggaatagcaccaacatccggcattttcttatttcgtttttccggaggaagctcagcattagtttgaatttcgattattttagacgtagcattaaacatcgccctttgctgaacatatttttctgtttcttttattaaccaactgtggtcttccggagaatcagctagttttgaaataagtgtttttacaccagaatattctgtttcagtaaatgaactattttctaatgcaacatttaacgcattaatagatggaacgctatgatactcattaacatgagatttaattaatttgaatgtatttttagctggaccactttcaaaatattctgaatccatatatggccaaacttttgaaaaataagcttgatcaaatatgagatgagaaagaataatttctaccacacttactccttaaaagaatttaaattttttctttgaccttttattaaatgcatcttgcagttgcattgtaatacatttttctacatgaggagctaactcagcttttctttcttggtcaagaacagcaaagtccattacaacctttccatcaacccaatccagtttagttacatacactatatgtgtagaaccgtcttctagtttaatgacaatctcctggataacattttccatggcagatttaattatcttaagagattcattaaaaagacgttcttttctttcttcttccccctccgaagagggggattcatcgataatttctagatctaagtctaaatcatctttattcattaaattcttccatatcacttaactgatctaggtcagtttctaaatcagctgctgatttacttttactttctggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcaattggtatcttttgcacgccaagatttttcttcgcgaatcatctcgccggtttcttcatcaagaaattcacgagcataccaaccattcttaggttttaccacaaatcctaattcaagagccatatctaacaatccagaataaggatcgatgccaccgtcaaatttaacatcaataaagaatttacttttttctttaacggtacgagatttttctacatttagaacaaattgatacccctgaagatcagaaccatctttaatctgacgcttaccgataatgaatacagtatcagccgaatacattacgcctgtaccacctgtcatcacggttttactaaacatttcaattgtttcaattgtatggttaaccgcaacacatggaatatttttaatgctaaagtaaggagtaacaatacggaataatgacttcagtgatttagcacgagtcatatctgccacagatttttcattcaaggcatcttcagtttctttcttagaagccatattaccgattgagtcgatgaatacaataactttttcaccgcgctcaatagcttcaagctgattcaccatatcaatttttagctgttcaactgactgaattggtgtatgaattactcgttctgggtcaacccccatggatcgcaaataagctggagtaataccaaattcgctatcatagaatagacaaaccgcgtcaggatatttgttcaaatatgccgcaaccatagtcaaagacatatttgatttaaagtgtttagaaggccctgcgaaaatagttaaaccagactgcataccgccatcaatcgcaccagaaatagcaatattaagcattggaatttttgtacgaattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctattggatgaatagcattaaacttatgaaatgcttctgatttttctttacgcgaaacgcacatgcgaagaacctttaatggctcgtcttcttcacccaacgattttcgtttttcaatattagaagttttccaacgagcttgctctggaaactctctattgatttgctcaagcgctctattatgtttagaattactacgaattgaactgcaccctccaggagcttgtgcttttccagatacaaccagatatttgaacaaggccaaatgcggataaccttgattaattaaattgagaaatgcatacatatcttcgcacaaatcaatttttccatacccaatttgttctgtcgtaagttttccaaggtcataccatgtattcgtgaatccatatgaattttcacgataattaccccaagatgaagtaattttaaaaattggtaggcgagcatgaccgtgataatacccacaatccatggcatcttcgacgtattgaatcaattcatagaactgttcacgagtcaattgattgactttatccacacaacgacgatcatctctttttcgcattgaactcatacgaatagtagtatcatcgtcaatcatccagattcgttgacctgcatacatatcagtaattgctttacgagtaccggcaattccattaacatcatcaggaatagttacaattttagctttagacccataggcatcataataagctttttcttcatgttcacgtactacgatatgaggttcataatcagtcggaaacatatcaagggcagaaactgcccctacacgttgatagctcggaattacgaattgaatcatttaagtgccttacatttgtcaaaatggtatcttgtcatatttggcccacgtccttttagtccgcaatgcggacatattttttctatcaaattatgaggtttcctttacgatttttagacatcgtttctttaattattttagctttttctacgccaaaaatttcttcataagttttaccagaattttccttggctcgatttataattccatatgcctgctcatttttaccatacattggattaccttcgcctttcattcttttagaatgatcaggacgcttgattccacgaaaggcatttccgcacttatatctttcttctggagatagttttttaccgtacattccatttaatttgcctggaaaacttcctccccatgcttcattctttaaattatatgaatccggacaattagcagcatctaaacaagttaaaataatttcttcaacctgtctaaacattggtccttcatataatatttctttattaaagaattttattccatatttctttttagcatgttgccaaactacacccgaaccatcataattcgggttgtgaccatcatgacttcctatataccactttttagttttaggatgtttatacttataaacatgtggcacatttacttccattttccagtataatcctttttagcaatatgagtctcaccggtgttccaccaatggtcaactaaataaaactgattttcgtacacatgaagacttccaacgttccatataatagaacctgctttatattgccgcgatgggtcgcctgcattcaaatcagatactaatttatctagtacgtatttttgccaagcataatcattacgatagcctgcccagcaatcattgcttctcatgctaacaaccgcattgactttcttatcacgaatcaggtactgtactgtattagtacacatgaaatctgacataccatctttattgtagtcaaattgcatggatggacgagtataaatcatgataccacgccgagaatcaggattttgaccaagttcagctaaacacatatcatactgggcatagttatcttctgaccaaatagcccaaccataattcgagttaatttcgcctttagaagatgctacctgctgccaaatctttggtgtttcacctggaatatctttaacaaacaagctcttagatttataccattcaagttcacgctgaatgtattcatcattaagagcgccaaaaataaacggttcatctgctacaaatgatgcgccaataatttcaatagttttaacaccagttttatcaactacgaaatctttttcttttaatgcaagccccaaatgaagacggatttcttcaactgtcatagagtcactaatcatttaaacctcaattgatacattcatatttaacttgtaacagtaataaaccccaacctaaaataatagttggaatcataagaggaaccgttacactatagtatatacttattataatcatcaagattaaaagcaacactgttataattttgcttttcattccttctctctgatgataattacctggtttggttgtgcagactttttagtttcacccgcaattgaccaaataaatgtaataaaccaaccaataattgaccagttaaacagtaaagatgtgaaaaagattcctactgtcgattttgacccacgcatcaaggcgataaaccatggaagcatgtatataataatagccaacacacctgaaactaaaaccataaaaattgaacctgctactaaagtttccatgttttcctcacttagtcaaattttttacacatgaattataagaattcactacatactccatcggagcatttttaccggtacgccattggtaattattagcccaatttgcccaaagctcggcgcagtagttttcaattttttcttcgcgtgtaattacatcagaattacgatatgcttgagcagattcatctggacgaatagcctcgtcaaaattcgcctgcatttgttctactgtctgttttggagcttctttataacacttgacattaggattataaaacttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacggtgctagatttaatcacaggttgagtatcattttcaacactaacaaatggaactgctactaatgcaactaaacaaactgctaagcatcccataacaattttcattttattctccaaatccgtattagttgatagttgtatagtaccacagaggaacagtcttgtaaacagttttgtgaaaaatttttttagggaattctaaaggtccagaatcatctgtttttcataagtatagatttatattacttgtatgaaaaagggacccggaggtccctagatttattctatcagccaaacaggaagtctaacgaagctttttcttcatagtccataccagccgattcacacatacccgcaagcggtttaacaaacgatttttggaacaaagttgagtagtcaatccaagacagtacgtcagaacgaatttcttttggaagttctgtgcccgacggccaagcaatacacttgtcaccaaatggatttccttcacgtaatggaagaaccattaccttatttccatccaaaattggagctacacccagaccactaacagctcgacgataagttagcacaccgcgaatatggaacgggcatttaaaccctggccaacctttatcatcatatttcgctatatcgttcgcggtttttacttcagcaataactttatagtcaagttgacgatattctttctcgaagttcttgtagtattcttggacagactcttcaccttcttgaagaatacgacgaatactttcttcgagagcttcttgcactgcttttggtgttgaactctgctgagtttccatacccatgatttttagatgcggttcagcaaatcgtttatcttccatatcataaacgttcagagcataacgctttttcgctttccaaaatccaccaacaccctttgaaccaagtggagggcaagaaatagcttcacggtccatatgcatcagatgctcgcggttattcatataatcacataactcacgatatgcaacatcaatcataggttccatctttttcttaccgaactgattcatgaattcaactaaatcgttctgctctttgaatcggtcaagaccaactttttcaataactttatctacacaaacatataccgaatcagtatcacctgctgcgatgaaatcttcaccattagttccgcatactttattcagatattcattaattttacgagcaatccactgaataccaacttggccgaaaattgtgatagcagtagcatttcgcaaatcatagtaacggaaatgaatattaccaagagcgccataaagactgttaatgagaattttacggttcagctgatttgtattagcaagtgtagcagctttttcacattcttcaatcagactattgagaacagattcagtataattcgatagttcatttaagaaatcatcactgaacttaacatatcgttcaacttcaggtttagttgaacaagaccctgcgcctttcataataatctttttaatagcttcggcattcatttcttcagcgaacattttctttttccaatctttacgctggaaaaatactttagcgatttcctttggaatgataccttcttgatgcttatcatacatccatccattcggagaacaagaatattcatcactcggtttaggagctgttcctgcgatatattcatgaattggatgaactttaaactgaccacgaatagtctcaggactaatgttaacctgacgaataatgctcggatacagagacgtcaagtcaaaactcataatatatcgacgagcaattggtttaggttcaaatacaaatgcacccggaaaactttgtttaacgtgcgaaccttgttgaggaataaccttatgttcacctttcaatgagttaaaaataatagcatcccaagttttaataggactcattacaccagaaaaaggcattttagcataataagacatacttaaaactagatcgataaacccgcgaattttatcaattgcttgaactgattctacgtcaatgatgttataactaatgtatcgttgatgattagtctcacggagtttattaataggaccgtcgtatggtaatttaccttttttggtttcatgttgagcaactgattccaaagagaatgacggcaaattagtaaaagcgaatttcttgtacaaatctaaataatcaagaatagatacgccatcaatagaataaatttctttgctaccgtacatattttgaattagtttagattttacccgaccgattggagagaaacgtttcatactgcgttcacctagaatcattttaacgcgattcatgatatacggaacgtcaaatccctcaatattccaaccagtaaaaatagcaggtcgtttctgttcccagagattgatatattccatgagcatatcacgctcattatcgaatggcatataaattactcggtcaagaatttcttgaggaacttcatcgccaccttcacagtcaagcttagcagctaactttgcatcccattttgatactgaaccgtacattgaattcaaaaggtcgaaaacataaaaacggtcatcaattgaatcgtaatgagtgatagcatcaatttcatattctgctttcattgggtcaggaaatttatcaccagtaacctcaatgtcacagttagctacacgaacaaattttcggtcataaacaatttctgaaccatatgtatcactgatataagcgagtttaaaatcgttcataccgagagcttcgagaccgatgtcttccattcgtttcatccaatctcgagcatctttcattgatggaaatttttgaggagcgcagtttttaccatagatgtctttgtattttgactcttccttacaatgcctaaacatagtcggaagatattctacttcacgagtacgttcctttccgttttcatcaatataacgttcaacaatgttatttccgactgtttcaatagagatataaaattctttcatagatattccttagtttatagcccgagttattaggctcttgatatattatactccaaataaggggccgaagccccttgcttaattaccaatcgtatatttaggaacgagtttccattcatgtttttgtttaaaagaaataactcggaagttattagttaaatctttcataaaagttctttgaccgggaacgatttcaatcagcccccaatcttctaacagccatgcaatcgaatcacgacgaacttcatcttcttctgtcatttcaacttgacggccatccatacgaagcatttctttaaaatgaacgatatagtatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaatcctttaagttcttttaatactaaaggtagttttccatttttagtaagaattgatttatagttaattgcatcatttgtattaacttgataacgcttagcaagtaacttaataatcaatacttcggtggaatcttcaactagttttgcccatttaccatatcttttaccacgaggaactgcagccattagataattaaaatgggcttcatcacttaatccagaaccgattaaattcattgcatatacagctggcatgcattctggaaattgtgataatgcattttcaaccatgaattttgaataatctttttgagcaatagagcatttagttttattattgatagctccaattatttcaaaaaattcattttcggctttttctttaaaagaatcagcagcggattggacagctgtccaatcttttgaataccaagcaatctgatgctcgtttaattgaatatcatcttcaaataagctcatatcacttccactgcatttcgcacgctaattgaatgaaaagatatgctaaatgtaattccgtattagccgcaattccatgatactgattattttcgccaacaatttcgtacatacgaataatactctgtggagttacacgtgaatagatttcttcggcaagtttacccacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaacgtaataactcggcagcgtgactgaagtggtttaataataccatcaatattattagcagtaataataatactacagtttgaactataagcttccataaaggaacgaagatgtcgctgagactctgctaatcctgagcggtcaaattcatcaataacgattactttttgacgaccatcaaatgaagcggcgctggcaaaattagtcaaaggaccgcgataatcctgagcggtcaaattcatcaataacgattactttttgacgaccatcaaatgaagcggcgctggcaaaattagtcaaaggaccgcgaacgaaatcaattttacaatctgatccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctttattaaaaatcgtgagtagaatcagcttcaagagctactacataattcgcatgttcaccttcaaatttagcagcaccttgtttaccttttgcccagagcagaagtttataatttcctggttgcattttcatatttgccatattgataatgaaattaaatgtattttcaccatcataatcaccaagagtcaaagaatatttaacacgggtcagagcagaatcttctactttattaaaaccgttaattacgattttaccttcttttaccgtgatagcaattgtatcaatttgcagaccacgagatacgcgcaacagttgttgaaggtcttcagctttaatttcggtaacaacagatgctaccgggaatggaattggtttattaggagcaactactgtactcggatcggctgctggccaaaaaattgttgagcgggcatcagcaattttaatatttccatcttctgactgggaaatttctgcatcatcattaactagagacagaataccgagaaaaccgttcaaatcgtaaattgctacatcaaaatcaataacgtcagaaatatttgcttccgcataagttgtaccattaactgcgcgagtcataataaattgaccggatttaagcataataccagaattaatagtagcgaaatttttaagcagagcagtagtatctttagacagtttcatgtaatttccttcaattcaaatgagatttaattttataactaatttaataaagcaattaacgattaaaatcagttgcgattgtttcggcaacaatttgagcggcaacaatcagacgttcatctgcattgccacaatattcatcttcaaggcgttcaccacatgaagtcataataaatttagcaccagcgtttagggattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcatttctattggacattatttttgtatattctgctttaaatgcattcctaagcatagattcagtaactatatgctcttcattagaaaaattatttctcagaatatatcgttttatttcaggaatagttaatagatgctgtccggttgaatattccatgtttttcctccatagagattatactctaataaattaaagcataatctcttataaattaaaccattacagtaaatcgaccaactttcttcatttgaagatgctgaccgtattcttgcgggtcatggtctttatgcgaaattataaaaacattagtgtttttcattgaatttataatattagctacacctttaataccttcggcgtcaaatgacccatcaaacacttcatcgagtattaatgtactaatactaacaccagatacaatagaagcaatatcacgccaagtaaataaaagagcaatatcaattcttgccttttcaccttcactaaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagccgctttaacctttttagctttatctactgctgcgatcaaagattgctttttattgcgaatatcatttgccaacgactgctgggttttaatattatctcggtattcatcaacaagaacttttaaattatcacgatgcgttgaaagctgttcaaacgaatgcgtacattcagaaactttatctttaattttagaaacaactttatcaccggaacttaattgtgacaaacaggttggacataatccaccttcgtgatacatattaatgactttattatacgagtcaatttttgatttaattaaaactgcttcttgaccgattttattaaatgcatcagtagggtcttcatctaaaacaatattaactaatctttcattagcttcttctatttccgattttagcgttctagcttcttttgccaaatcatcatacatattttgcagacgagtaaggttgtcacccgttaattttttctggcgttcaacgttatcattatatattttaatttgttggataatactatcttttttaacgtcaagcacttggttttgtgaatttaattcacgtattagtgctttattaagcttatccatttcagctaatgttcctacctcaagcaggtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcgaaaacgtttggtttttgtcctcttttgatatagtactttttctcatcatattccatccacagttcaactaaaagttctttcttatttgtgctgtttattaattgacctttctttacatcacgaaatggcttgccaaaaagcccaaatgtgatggcttctagcatagtagacttaccaccgccatttcgtccagtaataagagttttttgaaccttatctaattgaatgtcaatcccattttgaccaactgacattatatttttatattttactctattaagtttaaaattcttcacaaaagattccttttaatgtatcttttagaccattctatcatatcatcataatctaaaaagtattcatcaaattcagccatgcaaacaacaccttgtgctgtttttgatgtaatataaattattccaacatatctagaatcttcttcggtataatcaatgtttgctatgaattcatcattaatgtcaaatgtcgaaaacttcacagtatgcatccttaatacaagatacagccatatcttgtaatgatttaggtgtgtcattatctaaaatgttgaagttaaaagatacagcccagtcagtgcagactgtaacctttttaatacaattatcttcaacctctaacggttcaaaccaatattcaataatttctttatgaccaatatcatcttttacttcgcattcaaaatgctgactcatcataacatttttaaattcatcaaaagtcattgtgttgcctctacatataactgatttgcatattgaataagtgcttcacggtcagaatcagtgatgtctggaattgcattaatgtattcttccatcaacgtctgaagagattgaacttcaacttcttcactgtcatctgactcgacagagttatcaatctttgacacaactcgtaatgaatgcacaactttttctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcacctgcagttagtgtccatggtgtcccaatatatctgacgttagcagcctcagagatagtatggaagtgaccagaccacacctctttataagtcttaaggaaatcaggttcaagaccgtgagatttcattcctttataaaaataaaatccattcagttcccagtgaccaacacaaaaagaagcagatgaagttttgatatgctcaagaatttcaccagtattttcttcacacatccaaggaattaaatcaattaaacatccgtcaaaatctactgtagtaggcttatcatatactttaacattaggatatttagccaaaagctcagtagaggcatttggagttaaagtatttttaaagtgcatatcatggtttcctacaatagtatgtagggtaataccagcatcatcaagcatttgaactatttcacgggcgaactccatagttttgtgtgtgattgcttttcgcacatcaaaaatatcaccgtattgaatccaggtagtaattccatttttcttagaatattctattgcttgtttaattccatccaactgaatggattgaacccactcatcatcggctttaacgcctaaatgccaatcacctaaatttaaaattttcatatatcaagaaccgtcattgaaatgcaaaataaaattattgaaataaacccatctggcgtgctaaagaacccaatccaacatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcgcgttcacggtcataaagagttcggtcagatgacagttctttaatacgttcaaatgttgattccatgtcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaactgtttcaggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcgtattcttttgctaataaaaccggaattgaaaatgatttataatcatgcgcacaattacgagtaaatgatttatctttagcataaaccaaagttacttcatgaccatttttaataaaccaatcacgctgctcaagagaaaatttagttacaccgcaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcataactgccaccattttttgacttgataagaatcaacccacactttcatattggggtctgctcttacaataggaggattaacttctttaattgaactatcatggtattctttttcagaaattttcacacaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgtttcagaatatcccgacttttcttgatagcatattcgtattgagcaaaattattgttttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgttggacgaatgcattaaaacaagcttgagttatatacgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaagcagtatgcttggaacactttctccatcatctttttaaattcatgaatatctatgtaatgatcattaatatcagcgcgatataaaaagtctaaaaactttttatgggtattagaatatttacttccagttaattcagaaacatggctttcccaatatccaacaccagttttatttgggaaaaatgaaattttcatgtattggtcaacatagaaaataccaaaattttcaatagcaatagaaatattaattaatttcatacattcatcaacttagccgcttcaagagctgcatctagtgaatcaaattggtcaacatattcaatcaattcgccgtaattggcatataaccaccattggctaaattcatactcaaggatgaatccgtttccttcaatttgagttaaaccaatgccatttgtatttacttcatatccagcaagacgcaaatcgttaataagagcttcgttcataattataccttagtaattttcaggtctgcaaattttttcttacgttgatttttcatgcgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcaaagaaactactttatcatatgcgtaagaattgatggcgtttttaatttgaatagtcatacattatcctcaattacgttaaaattttattatccaaaaaagggccgaagcccttagctaaactttttggcacccttccagccttcgtacatcattgcgactgacaatgacaaagctccttcacatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattaccattttcatcaataaatttaatccagtcatttactgaccacttagttgtatcaccttttggggtaacatttaaaatatatagcccttgcttaaaaagcattcgtttgatattcatattttcctcagctgtaacgatagcactcgtttgatttacgtttagcaactcgttgagaaatattataatcaaaatcatcgtcaatgtaaactgattttttcaactttcttacttcaccacgtaattgacgattcaattcattcttaacctctgaatcaacacctcgcatacgtcgccatttatctgagcgaaaaatgttttcaaccatatctttatgacttacaccatcaggagctttacgctttccgaaatagtcataatcacgcacttttaagtctttacgacgatacgttttacccatggagtttaatttccttagcaactgaactaaatgcagcacgatcgcaaatcatgcgtttatgtaacttgagtataatatagcaaacttcaaaactatttacatgagtaacacgaacagcattaccattaatgagataatactgtccctttttaatttctttatcaaccataaccatatcaattcctcaaaggcaattcatatgttaataataccacagtttgagctcgttgtaaacaactttgtgaaaattattttagggaatgataagaagggaacgatagcttagaatggtaatatacagaatgtgagaaagaaggacccagagggcccgtcttagtcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagcggacgatcatactcaatcttaccgttatttgtaagaactttatagaaagtaaaaggagcattgagctcctttagaagttttgtaactgattgacatccaggacaacgacctacttcttcggggatgccatagatttcaatcttattctttaagttcgagttttgttccacgagaaataattccttgataagcccagtatggcgggttaacagaatcctcaccagagttttcttcaggaaaataaacctggataacgaagccggattcatcaaaggtgaaataagtagtaggcagttcacctaacaaatcggcacgagcgttgatttcttcgaggtcttgttcacgtccagcccagaagcttgggttcagactacattcatagaaataatagtcattaccgaacatatcaaaaccattccaactctctactacataccgctcaaaactaatcataattaagcctttttatcaagaacagcattcagcttgttagtaattttatccagacgctcattaaactcactagaagataatcccttttctggagaaattaaactaatcacgaaaaatatagcaataaaaggaataaggaaaatagctccaactgccataaacagaaagaatgttacagttgtaagaaaatcagctaaacctttacgaaatttatacatattttacccttaattaattaaccaagcattgataagcactaaactatattgggaataaaattctggaccaaaatgaaaaatcatatcatttatagtatccataatgtaattcagtttaatcatgtttccacaccccatcggtatttgaccaaagtcgctgattatctgatcctcgccacagctttttagtcggaagatttttctcatacttcccatcaataataacatcaacatatttaagcatttctagctgtttaatatcttcaaacttatatcctgtccacaaccaaatgcttttattgggataaagatttttaatagtttgaaccacagagtgaatcacgtctctgttatcaggataaagagggtcacctccggttatagttaatccttctatataatcattattcaaacattcaatcaattgttctagcgtttcaccagtgaatggaataccatttctagcattccatgttgatttattataacacccttcacatttatgcaaacaacctgtaacgaaaagaacgaccctgcaaccagggccattcacaaaatcacaaggataaaatctatcataattcattgatgcttaaccctatgcatgatttctttatttttaccgagattaaatccgcgttcgttcgggtttccaagatatccgcatgttcttcttattgtgttcatctttttaggatcagtttctccacaaatagaacaaacaaatccgttttcagtaggagtcatttcatgggtacttccgcatgtaaaacacttatctactggcatgttaacaccaaaataatctaaatgttgtacagcataatcccatacagcctcaagaccttttaggttatttttcatatcaggaagttcaacataagaaatgtgaccacctgtcgcaatgaaatgatatggcgcttcacgagaaattttttcaaacggagtaatattttcttctactgaaacgtggaaactattagtgtaccagcctttatcggtaacatcttttacacttccatatttttctgtatcaagtttacagaagcgataacaaaggttttcagcaggagtcgaatataaactaaaagcaaatccagttctttcagtccactgtttaagatgagcattcattttagttaaaatttcttgtccaatatcacgaccgacaagaatattcaattcgtgaataccaatgtatcctagggacactgaacttctaccgtttttaaataactcaattatgtcgtcatcaggtttaagacgaaccccaaatgcaccttcttggtaaagaataggagcaacagtagctttaactccttttaaggaactaattctacacatcaaagcttcaaaacacagatccattcgttcattgaataattcaacaaatttctgttcattgaactgtgttccaatataagaatctaacgcgatgcgaggaagattcagtgttacaacaccaagattattacgtccatcaagaatttcattaccggttgaatctttccacgcgctcaagaaactgcggcaacccattggagaaacaggaatagatgagccggtgatagctttattgttcttagctgaaataatatcaggatacatccttttgcttgcacactctagagcaagctgcttaatatcatagttcggatcgtctttataaagattaacaccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggagtctgtccgtttgaactaaagagagtatttacttcatattcataagcttggaatgcatcgtatacatctttttctgttttagattgagcataattcaacgcatcggcgatttgccatttttctgcatcctcaatatgttttgcataggtgcgtttaacataaggagaaagtactttatctacattcgcaaaagtcgttccgccgtattggtgagaagcaacctgtgcagtaatttgtgccataattgcagtagcaacgccaattgatttaggagtttcaatctgtgcattaccaagcttaaatccgttctcaagcattccttttaaatctactaaacagcaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaactgtgttttggtgtcagattcattatattcaaatcctctttgaagcatctcggccatcatttcctcttttcctaaacgagaaaattcctttgatttatctccaacaaagttagggtgaatattattttgggtgtaatcggattttaaataagtaagtaaattttctaaccattcaagataatcaacaccttgtccctttaagccagaacgattaaatttatgcttcatttgaccttctgcggcattgcagagattacaaagcaatccacgtatctttcctgcttttggtccatttaattcatggtcatgatcaagatgattagcttgaacatcaggatttagttctcgttggcaaattaaacatttaccgttttgtgcatcataaaatttctgtttttcttctttatataatttgccagtcaataacataataaacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgccttgtcagaaaaagaattttgagttttttcaagtattataaaacatttgatgcaatcgcttatattgccgaatcatttggtcagaaaaagaattttgagtttcaagccattcaatatattctgccgcagcttgcatcaggttaccttcataatcatcaatatcttttttcaatgccactttagctaatgcatatgaaatacgttcaccttgaaaagcggctttaggcttctgaacatcttggctagttctctctacaacttcctcgatttcaccattttcaacggattcagtattccacaaacaccaatacgtaattggcttatcatagatgttaataatttttccatcagaaagttcaatttcaataattccagtgtcaggctctatatcatcttcacattcttttgcaagttcacgaactttaaagacagtacctgcactaagttccggccagtaattacacagccctgtatcagcacgattaattctaaaccacttatctactgtaatcatgtcccatctccatatcaattaagtcatttatcgttggttcattatatactgtttcttcatcagtgtaaaccggttcttccggctctggctctacagtttcccatctagccgcccaccaaggtttaaccccgaagcttattaagttcttcataatcaacccaggattctaatcctgatggcaggtcacattcaatttcccaaagaagttcttcaattttatgaagacgatctaattcttcaacaggaatagtaaccattgatggagctcttgctgcactaatatcgtatatcatatttaccccagtttgaccatacaatcaccgtatttccacttagaaatagacttttcaccattagaataataaacttcgagtttagcacgattatttttaatttgaataaccttggctgtcattaaagttccatacccatagtaaactgcaacttcatcacctacatataccgcgcttccgcggtaatcatggatataatcagttccttcgagcatcatttaaagtattcccgcaattggtcaaatccaccaatatgacttccatcaggagcaaatacctgaggcattgttaagccgatttgagtatcacgacctagtttagtcagaagctcagcgattttctcatcatcaaaaacacctttttccggcataatgttgataaattcaaacggctgtttcttcacggtcaaaagacgttttgcattatcgcaatacacgcatttgtggatgttgctatcataaccatatactttaaacatattattccttaattcctaatacttgtttaaaagtctcgtcgtaatcaagactttggcctgtttgttctttatgtttgtatataatatcacttacttctgatagcatatttttatatgaacgagttaaagcagatttaagcacgctgtatctatcaggaaatttaccatgttcattataatacgctattgctaattcacggactgccttttcagcaatctccatatattctttacgcttggtcattttcttctcggttaaatcggtgtttgcaatgacgacatttataacgaagaatactagtctgccaatgaactaattgtacctgttcagtaccacactttgggcagtttggaacattcttagaagattgctcacgacgactaaccatagccataatggcatcccatgctggaggtttaaagtctaaatcgtcggtaactagcagccctttatcaaacccagcgcatggagtccattcaggaaaatctgaagcttcggcaatatcttctaataagcgctttttcatttcagtacctcaatagcattacgtaaaccatttgcttttgcattaagagcttttaacaatttggtgtgttcggcaatctgggcttcaacttcaaccagtcgagatttgagatattcgcgttcttcactcaggttatcagccttttctgctttaggttcttttacaactggcttatatgtattagggttcttcagtttaattagaatgcgtgaactgtacagcattgaaccattatcttcggtttcgtcatacatttctactacgtccatgatttttaacatcatgcggagtttataagacaacgaacgaatagttttgttgtgcttattaatttctctagagttcatggtgccgagattacgtgagtaataataaggaacctggatattaattagcactgatgaaccacctggcttatgtgttacttcatcagcaataacccaatccttaacatgaactgtatttgtacggtcatcgcccgcggtaaatagtttacgagcatgcttaaaaagcatattcacttggtcattgaattgacaagcgaatttatcagcaaatttagtttcgggaatggtagataaccaatcagccaaatgggtctttttaacatcgttaacaatagtaaattcaaccaaatcggttatagatgtcgcagttttaatgaatctcggcttcataaagtttttaatgttatcgcgagctacagtagaagataacatacgagaacgtttaaaccattcaagtaaattgcctaacgaatgagaataagcgttctgagtatctttacagatatgattttcctggccaacatactgaaggaaatcacgaagaatattattgattactgctctgtgtccgatctgataattacggtgtttagtaataaggctgtcaaaataatcaatataatgtttacgagttttcatgttcttctcacttggttaatgatttatactccgagccatccttggctttaaattacttaattaactgtaaagcttgttcaagacgatccaggcgattaacagattcttcccaaatccttttagcctgctcatattctttctgcgctttattagaaatttctagaacttctttataagctttttctagtgcaataacttctggacgaatttctactggttcaggcgaatcgtcaagacattccattagttcctcaagggtagtttcttctttaggagtattcacaatttcatcacatttttgttggtaaatttctttatcagtcggtgagtacgcacactttacttcacggagactaactacaattttatatccttcccaaccgcatatattcttaaaaggataagtatgaatattttctactgtttccatacaaagtaatgcggtctctaactgacgagttatatcgctagcaattgagaaaaatttattaatgttcttttgattagcttctggtgtaaaaaattcataattcacaaaaatagctgctttatttttatcaagctcatattcttttatgataatcatatcagaagcccaaggatggatttgacgataatcaccatagcataatttagaagctgattttagaatttgcttcttgaaaagtctaaaattactaatccaacgacgagtaaaaatattctcagggtcttctttattattaagatgataagaattaacatcaccgaaccaactgtatcctactacatctttagttcgtttaatttctttcccaaatttaccaagaatatcttgattaactaaatatgaaagaagacgagaacctttaaaagtttccttaatatcatctttatattcgcgactagaaattttatgaacttcatgaataaatttgctggaagaaacaatacttgcatcaatattattgagccattgattgataatggaaataacactattctgactaaacacaggtttaactttatcatcaataacgctattgaatgatttgatatattcgttacgagtcatattaatctcctcagtagaaagtaagaacattataccacatccttgtggcaaagtaaactagtttagtgcatttagtgcattgttcagtttagaacgttgcttcgtaagatttttgactttttcttgtgctttttctagcatcttttcagcttctagcacttcattggtcgctttaacgagttcatcatctactgtcttaagagacttctcaatcgcatccgcgtgccatttttcaacaggtttaagactcggattttcaataggaagaaaattcactttattaaatttccatgcatctttattacctgagctatacatccaaaatttaggatcgtttgatgagcaattagataaatttaagttatcttgcacttcctgctttttctcttgcgggacttcgtcctttctcaaaaaatcgtatttaaatgaaacgatcatatcaagttcatacgttgttgtatgttcccaatttcgctcaaaatgaggtaaaatcttagattgaacagcggcaacaacatccatatacttaaatgcttctgtcaactgtgatttaaggcattcacaaattgaaagagaattttttgtattaggtttaaagctaattcgtgcagttctgttattttcttttaatggtcttacttccatctgaagagtataaccatcaaatttcaggttctttaagttaatatcagaaccttttaatcgactagccgtcgacaaaatttgctttaattgtttacggaatagagcaataaatctccattcaatacgataatgatttggattaaaaaatccagatgataaattaaccttactctgaccaacgccttgaacaaatagaggatttttataatcaatagttttaccgaaatcggtgagctgctcacgagcagtcatttgtgtaatataccccgctttactaaaatgacgtaaccattcactgctattcatatatttaaagtgaatatcacgattaactttatcagggtctaaattattttggcacaaaaatgtcataacatcacgagtatagctggcattacgaaccatatcttcaatttgagaacgagttttcatagtgttccttaagatttaagtaaatcaacaattttaattaacttttcacgctcagatttagctttactactcagtccagatagtctgaaaatttcatcatcatattgctgaatagaaatattcagctcttcaatctgcttattaaaataatcaatttgttcagaatgtttttcgttactacgaactggtacaggttttgtaggtaatttagatgaactggattcatcctggcgataaattaaaatacaacttgaaccaattggacattttgcaccagatgaatattctaatgttccagcttcttttaaaacttcaaaagctaaacagagatgatgccccatattgacataatctgtagagcgagctctgacgtaataatcatctccgcgaatactaaatttaaagcatttaaggtcttctgtattattggtcttaaaaatcatttgtttatctagacccttagctaatcgagcgcctaatgctaataatcgtcgttgattttcccacaaatcctcaatcatttgatcgaatgataattttggcattagtcgaccataaaggtcatatcctttattataattacgaaggatttcactcgcgttaatacgagacaacgctccaattttattaagggctttcatgatgcgattagataaacccattccagacccgtttgttcgttgtaaatgtttttctaatccaaacccaatatcaactttaaatttatctaaaatttcagcatgaacgtctctgtcaataacattcaaatccaaagttgggttaaatctatgaaaaaatttatctggctctccacgacgaagtacagtccattcattcaattttttattaactaaagatttaattactgcattgacattattaattactactgacatattttcctcactcaatttcaattttactaaatatacagaataagatagaacagactatataagcaccacacacagattgaactaataccattccaaagaaccaaacaatattatcaaacaatgtctgttttacgtcgaaaggacgtaaacttacagtaatattatcgcctttttctattgatgaatacatctctggtgaaatatattcgctaaatctataaccgtctttgagttcatatacggcaataaacgataaactagacccctttccttgagttcctgtaagggtattaactacagtaacatcataatctttataatgcatataatcattaatagcataataaccatatgcaactactacacataaacagcatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttgtaagtttcaatacgctctgaaatgagagtgtatcgttcatttactgattctttcataaaatcaggaatttcacgagaagctttaatctcgtcaaatttatcaataacagcttgctcttcagcaattaagttatcatacatcaaaatatctttcttgatgaactcaatatcttcttgagttacacgagataatttagatgctttatcctttttgtactgttcgttagtatcacgagaccagtgtaatgtacgatttttattcgtattcttataaatttctacaataccaatctcatcaataataacgatccaattccaacgggatttgtaaatttgtcctccatcaaccgtgatttcacctccgattgagatgtcattaaagaacttgctttgtgcttcagatttaaatttaccatcgttgtaatttaccaggttgaaaatatctttagcgttcattttgtgttcctccgtagttgatagttgtatagtaccacagaggaacggtcttgtaaacaactaaaagaaacttctttcacaattttttccactgaaccacgcactcactgctttcttagtctcaggagcagtgttatccataaaccattcaaaggcagcctttttatgattctggagggcttctcgggctttaatctgctcacggtctattaacactaacatatgagcctttcttgtcaccaagggcttcttatgattttttgaatattcccaatcatttgtccagcgcatcgttgttgcgaactgaaatactgcttctttaattttagtttcgtaaatttcacgagcctttgagtataacatcattacctccatttaccagtttaattctagtcatctttttgatggcagtccatataatctatttctgaactgcctttttgtcttagaaggcctcttatgaatttatttcagaagagtaacctcagcgatttcttgccaaccgtttttgtcggtcataataaagtcagcaagataaagtgcagtacgcagtgaaacattgcgtaaacgattaacattgactttcatccatgataatgctttataagtttcttcatcagaaagaccgcgcttttgcatcatgtcggttgaaagaataacatcttcaaccctgaccataatttcttcattagtgtgaacacccaaatctaaataaactgagcgggacactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagatgcagtgctccagcagactttacgggtctctccagtgtccagagcagctttcagaagattaagaatgtccatatcagagaaaacatccacatcatcaatcaaaaggacagaattctcttcacgattattccaaagttgttcataaagaccgataccggagattttaccgttaatgcttttatattcaatgtatccattatcatttgctttattcaaagctttatctaaagaatacgttttaccaatacccgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcgcctaagagctcaaaagttccagagatttctttaccgaagtagatacccttattgatagttacagttttcattttattctccaaatccgtatcagttgatagttgtatagtaccataaagctttatgcttgtaaacagttttgtgaaaaaatttttaaaataaaaaagggagcccgaaggctccctatcatttataataacttcggtggttttcaagataaaccctctcaaggaagtcatcccaaaaacccatgtctactttttgctgcataccgttcttagaagcttcagtagatgctgcttctacttgatcgaccacatcttccaaaaactcttgaaccgttttaaatggatgtttacccaacttcacgtcgagaataaatggagcatcttggagtggataaaccaagtcaccagttttgtaaatttccaatagttggagtccaccacggcaagcatgactcagagctttccagtcaataccttcattggcttcggccttacgagcacgttcaccgtattcagcatctaatttgttcagtgactgcttaagctcaataagagaaagcgttgtctgatatttacgacccaacactgtgtagaacgtctgtgggcctgttttctcatgattatggaacacccattcacagaattcgttttctggaagacgatgcttaatatcttcaactttagtacgacgctgcttaatagaaccatcttcttggtaatcaacccattgctcagggatttgattaactactttcaatacatcacgtaatgcagccaaacgagaacccttaacgccgtatttagaagcttgcttacggacatatcctaaataggatttcatgttagtcgtataaaaacgagaacggttgtcttgaataaacttccacacatcaggcaaatcagatttaaccactaactcaggtggagtgtgaagcatatctaacgctacagtttcaccatctgctgctaatttaaagaaatatttaagactgtatagttcatggtcaatatcatctttagtgtttttagatgatgtgttgttagtgtttttactcatgtgctctttaacatttccaataagaatatcacgagcaggaggaacaaagatttctttaaaatctacatcagattctggggtagaagttccataaagatgactaccaaaatagcttttcattactgttttcatcattcagccttatattcaataacaggacatactttagctttacgcgcttttaaaaattcgacgataatagatttcttgggttgaataggaggtaaacctttatacgccctatcaatattttctacatgtaaagcataatcctttttccatttataatctttatatttttcacgcaaatgtgcaggaataacaaatgaaccgataataagtaaaacaaccaaaagtgcaagtataaatgccgatggaagaagagtccataaactaccaaaaataagccatttctgtatgatttctgcacagataatagttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattatcctttcattgaaggtgtaacagttgttaaatacttaatcatagcttcagcttctgattttgataatgaaatttcttcattgttttgacgaatagaaataaaatccggatgacggtcaccaccagcttttaaaacacacatataagtatcagtttcatcttcaatatctgaaatgattgaagcagttccacatgaatgtggtttttgataaatcaatacagcttttcttccaccgtttgactgttcataaacttttaacacatcaaacaaatcgcttcttttatcaatagctaagatgttgttttcatcttcaatattaaatccttcggatacttcataaagtgtcacccataaatcaccaatatcaataacagcgttcacttttccatgactttcaagagcattacaaattttcttaatttcatcataactcattttaataatatcatctccttgaataaggaagatgtcatttttaaattcaacacgaattaaaccacttccacttgaaataaacatatttcctcactttgaaatcatagttggaatgacagaatcgagataagtctttagcgcaatagcttcgtctttggtaaatgtgacaatatgtgatcgaaaatcgtcgatttggcgaatagttaagacatctccctcttcataacattttgatacgtttaaaacagtttcatcattctgattgcaagcgttagtaataatagcattgcaatttttgagccattttaaactatgttttctttcattagaataataaaaatatttaatcttatctataaaactatcccaatggataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgtgtcaaacgatacatattatttactttttctatagctaattcaccaaaaagcggactaacttctaatactaatcgtttcatattgattctcttcgactcactcacaattacatactcctttgaataatatcaataatgttgttcaccagattataagtaaacattgggtaattatattgaatcattacatacacaacaaacaaaactttcattctcttctccttgacagttgacaagattactataccataaccttgccaacttgtaaaccgttaaatgttgttttcaataaaattctgaagctttgtgtgagcatcaaccatgattttcatttcttctttggcgaaagctgtacctctttcccgagaagaacactcatagtcagaaactgcattagcatattcttcaattagtttcattaaaaacatctgcttttcagttttcattgttccacctaatcatttcaagatattgaactaacttagctttagatttatccaaatcctttttagctgcttctataccatcgtatgaatatccttcacaatgctcaactgctaattgatatgaatctatttcaatatcacgtgctaatttaatgattttttcaaactgttcgcgtgttagcatacttacactctcgtattatgatcgataatttcatcaagaaacatatctaacgcttctatagcattatccactttagtttcaaagtctttaatgcctttattcgaaatacccgatgaataccaagcaaagtcaatcagctcttcatctgctttgcgaattgaagccactaattccttaattttatctgcttgttcaatgctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattaagtgcttcaattttcatgatgttctcctctttatccgatagttgtatagtatcacagctcaaatggaaagtaaaccggtaaaatgaaaaaagtctcccgaaggagactaatgttattcgagggaaagaagatatttactctggtaaaacatcccagtaatatcatctatcgtgctttgaatggctggaggcatttctttataaatgctgttagattggtctagtatgcgatcaatcattttaattgtgtcggtaggaaatttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttgttttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcattccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcgcgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcatattcacataagctattaattcgttttctttcttatcaaaccgatcagcaaattcttcttgctgttcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatactgtaactcaaaactattcatttcggtttaccttctttaacgaaatctggataaggataaaatcccgaataaaatccttcacctttatgattgatgcatcctttattagaacaatagcaccaataatcgaaatcacaagccatttcatcgttgcataaagcaaaaacaactggccatttacacttttcacaatgggcatttttaagaatactagtttggctcataaccatgtaacctttaagcagtattcttctacatgctgtttacgacctttcttatcaataaaggtatattcaacgaatgttccaatgtagtctttatctacatcatgcggactattaattggacatttagtacggcaaatgcgttcccattgacgaataattactgccttattctttgggtcatatggatgtggataatgtatattcataataacggttcccaatcaacaatcacaatttctaatttagaggaatatgtatctaaaatcccctcaataatatcccagttccctttacctatgcctgcaccaatcctaggcatatagattgtaggtttaatcagtttattttcaccaaactcatttaattctaacatacaattcattaaagcggaatactcaaaatttggccctggttgaaattgagtataaaggttgaagcaatacgctttatgagtcctaaagtatttttcatagactgagtaagaaccgagtttagttacatcaccccattcagtctgtaatttatcagcttccaaaattttagggaaagctttggttaattgacccgctacgcctgaacccatagtatgaaaacaattgcatccatgcgcaatatttttaccttcagcgaaaagggcgacaatatcgcccttgatatattttacaatcatctagtactcaatcctcgattataagaatctaccaaacggtcaaccattgaatgacaagcggctttatctttctcctccgcaactgaacattctaaggtattccactttttagcatatcgttttaataatgtatcgtttttgtatctgcttgatttatctctttctccgtctttatatgcatatattaatttctgcgcaaattcagcttggcatgctttatttttcccacaataatccgcggcagtacggtttacatactctctaatttcagtatatgatgtatctgctaacgcagaaaatgaaattaatcctatacataaaaccaaaattttagtcatttactatttccaaaagtttattatttttaaggtaattagccttttctaggacttcagaagcatatttagaaccagctttaacattccatcccgaattataagaggatattgcttttcttatatcgcccttatgtatatttaaccaataagaaagttcaatgtacgcccaggaagctgaattggaccgtttattcaacattctttttatttcagcatcggtcatattataaccaagttccttgactctcgctcgcatagtaggcaaataattttggaacattccataggcatgatgctttggtttagattttaaattaactccgccagagctttcttgccataaaatagcagccattatatgacctaatccgctcttgtggatatttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactattgataattgccatcctgcattgaagcgacgggtctttgaacttcgcattaggtttacaaactgtaaatccaagccaaagatttccatctgtgatttctaaacgtccaggacggtattcaaccccatcaataaaatcctcatcaatgtcaggacgcggaggcatactcaggaattcattaacttctaaaacatggtcttttattttgtggaataattcaaaaacatatgtctcatcaatctcccgttgaattgcacgatcaagaagatgctgagaatattttagatgaaacgatgagacccctgctgcttttgatgcctcacgaatctcattgttaatttgacgaaactccgactcaaagtgacgacgaagcttatttcgacggataaaaacttctgtattgatagtcatgttgttctcctcttaactgatagaaaaattataccacagtcaagaggaaaagtaaacagttattctttaaatctaatcaatttattcatagactttgaaacttctgcacgaacctcatgtagatttttgagctgttcaagacgctgctcatagtaagcaatttcatcttcttcgagacagtcctgtgaatcttctttaagataccgtgcatagtcctggaaagcgttacggactacttcctggaagtcatcaagactttgaattttcttaggagcagcagacacacgacgaggggcagtataatactcataaccaaaccctgcgcttaattgagccattaatatttttcctctggttggaacacagcacgacaagcccacatactggcttctttgagtttcattttagcaatagctaactgatcgaggctttcagcataattcttcgcgagttcaaagtcttcgcaattatctagtgcttcccagaattcatcatataaagcatcaaagataagtcctaaacgaacttcagcgtctttaatagcatttactttaccgattttttcgtcggtatgtggcttataacctttaatatcttcaatcatatttgacttcctcaccagtacataaatcgtattcaactaaacgaataggttcatgaatgccatatccctgaacagaaatttctgtcgtaggataaattccactaatatcacccatattccacgcttcattaaattgctgttcgcctgaattactaaaccattctgcgaaagcatttaacacatctttagaaccttcaataattatctttgccattacaagctctcagtaaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattagaaaataattttatccaagattgttctttaattaaaaatggctcagaatcatatgccattaaactttgagtaattaatcctttaaatggtccatcaataaattccatggtaaaatatggaattttattcattaatcttgcattaggagcagtgcacaaaactctgcatcctttgaatacacctttttgtaatttgtattgcttgggataaaattcgctcaagacgttgttatttgccaaaatttcaaaatgattcaccaatttatttttaatagtttttggcgaaaaataaagatattcgaaaagttgcgtatctgtcatcattgcattccaattacgaaaaactgcggacgagtaataccgccaatgcagcatttactattgcagcagtgttgcacagtttcaatatgaatatcgtaaatcttatccatatcaggagatttgacaggctcatcaattatatacaaaattcgcgaaagcgataaacctctgaacttgcttcctttattaccaataaaactgcgtacagaatcagtaaataaacgaaaacgtatatcatcattagaataacgtgaaaattcctttttaatgttatttgcagaaattttagcgtaagctgaagtattagaaagaacaataactgttccgccatcatacaaccaattagcagcaaagttagtcacagcaattgatttaccagattgacgtccaccgtctagtcgaagtgtgcaatactgtttaagcaagtcttcaaatggcaggatatattcgtttttacaaatttcttctactctagcatcagaatggtgtgtaaaagcattcatcagggatagataaggaccagttaaaaatgttctcatttattctctctaaatttgggccattccatggcgcatgaattgtccatttctgtatttacccattaccgcacttgggctcgaccttattacaggttggtgggaatccctcacagaatcatgaggtccaggttattcccatgttatttaaatgtaaatatttttgccgtaatacttataccagtgtggcttcattaaaattttttcatcgagtcgttgttgactcaacttaatagctgatttacatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaggtgtttgattataccatctacttttagctaagttaactgctgcttcatcccagcgtttttgttgaagcatacgcaaagagttagtgaatccagctacgccagtttctcccatttggaaaaccatattaattaatgcacagcgacgaacagcatcaagagaatcataaactggttttaatttagcatttctcaaaattccacgaacagcagcatcaacatcctgattaaagagtttttcagcctcatcttttgtaattacaccattacaattacgcccaatagctttatctaattcagatttagcaacacttagtgatggacttttagtaagcaaatgaccaatgccaatagtgtaataaccttctgtgtctttatagattttaagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaagtcttctagaaggtctggattataatcgataaaaccagtctcttctgagcattctctttttgcagcttccagtgcattcaaatcagaactttctacacgcccctttggaatatcccagcgatgtgcaatcattccaggtttacgagaaccggtaactcgtcccataaataaatctttatcttctgtcataaagataataccagctgataatgttttcattttaatttcctgcattcagtgataaaattatttaatttttgagcatatttcttttcatcaaaaatcttttgttgtctgcgtaaacgccatggcatttcaatgaacatacgccatattcctgataatactgctgctgtaaaaatattaacaagtatagttaaaagaacccaatctcctattctgtccattggattttttataaaaaagtaaaatacgaacgatgatataggaagactaatgatataccacagaagaaccttcttatctgtgaaccaatcagcattcgttaacttagcgcgaccgttttgaatacatacgaacttatcatctgttacagtaaatggcttagctgcttgatatcccattctaaactccctaattaatcgtttctttgtatcttcagaacagccgctccagtcaactctatcaactgaaatgccatcgtccccatcatctaaatcataccagcgagtttttaaaatcatttaattttcctacaatcactcacaaactcttccattgattctttttcaatataagacatatagctattatattcctttaattgtattttgtaatccttttttctttgccaatttattttaaaattatcataatgaaaatataacatggtaccaaagaatgaaaataatgaaatcgctatagtataacaaagctcactccaaacttctgttatatttactgtgccgtcgatgtttaaaataagacagtcaatcattaatccaataagactacctgcaagagctgcaaatgctgatatggcaagaattaatagtgcctctggaaacgaatatttgactttatttagttttggcttttgcatcgtgattccttaacaaatttcataatttcattaaattcatacgcagcaagtttaagctgatgttcctttttaatctttttacactgagctttccattcgcgtacgcgtttacgataatgtcttccttgataccagtatcctacccaatttacaggtactaataaaaatggaactactaatggaagaattaatactaacagaaatactgcgtctgattcaatatcagtagtaacatctataactattccaataatcattaggattataaatgatacagctgtcacaggacctactaatacatcagtaggaattagctggcgctttaattcatacttcaacggtttacttggaaggtatagtgatggttttgacatattctctacattccttaacaaatttttctagtaataaatcgctttcaaaattgggattttctacgaatttatcaaaaagatcatcaacaatagttaagatattctttttactaagaatacgtttattttcatgcttcgtttcagaatcaactataagagtaaagaaatatttcttgccctgaaattttacagtagtatcaatataaaataaatttgacttttgtaaattacgtttaaaccatgcgtcacttaaactataaacaccgagataatcaaaatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatgcgtttaagagcatttagtaattggtctggaacatcaacctgtctttggaactcttcaaacattgaattgaaatcactttgcattttcattttcattcctatttactccaagtataaggggccgaagccccttatcattatttcagagaattaatgtattcctgaacatcggcagaggtagtttcaaccccagaaatattaccgttaaaggtttcaactcgagcaagggtatcttcaatatcaaccttagtcagtgctgcaatttcaactacatcatcagcagtactaattccaagggcatttgctgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcgtcaaattataggctcataatatctcaatcatgagcctgcgtaaacttatttcatattattgaaatattcttctgcgatttcgtcgttatcatggtaaactttagaagacagtttaacataaccttctgctgtgaacatattaatcacaacttttacagtataccactgaccgtcttcattacccattactgcgtaagtttcaaacatcggatgatcaggaccgataactttaatatcattcactgtacgaccgaaatcttctgaaacgcatttcataaagaagttgaacagttcgccgtaattatccatttcattctccaagttgttttctgtatcagtagttgatagttgtatagtaccatggaagaacagagatgtaaacagttttgtgaaaaaatttttagggaattctagggcagggatgggcaattaaaggataggataatatattataaagggtataaactaaatgatgcctagagaggtccagaaaggcctagataccaaaaagccctatcatttagatagggatttaaaattatttacctagtttacttattatagcttctgcagcagcttttagcttagatgcagtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccacttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtaacagcgttatccgagtgattcaaactaaaaagccccaacctttcggtcggggctaagaatgtcatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttacccgaagcctttgcaaaagcagcgccagtagcaactaaacttttccaggccatactaactgcatttcccgtaaatccttccgctttcatgtcgcgtgcaaactggaatcgcgattcatcagaagcatctttataggaatatttacccgcggcaatggcagcttttgcaacagcttgaatttcggtgctagatgcttcatttaacaccgcttcatttaaaaattgagtatatgatttcatcttatttcctgttttaatttgtagatttaatatactaatatttataccaaaaagccccaacctttcggtcggggctaagccttgcggcaaccttgtcggggttccacctgctaaggcaagtgtttgtacgaaacgccgggattcgaacccggttattaagtagttgacgctactcaatatttttaaaaggccatatctcgaccatatccgaacgttccgtcaaaaacgctactcggcttacggcaaagatatttcctcgaatcgataattcggtgcgccgtttctgctgtgatagtaaagagccagaacacagtaaaactgtgggaggaaactatactccagggaacatcagtccgacgacttaccggtagcgacccggtttcttaatattcttttaaagaatcaatatattcacggcgtttacgccacaaatcaattgcttcatacgcggattcagcatttcgaattagccggcatttatgtaaagacttatgattttgatattgtgtagataacggaattgtatctaaaaggtctttacgatcaaaatattcgtaaccatctaaaccaaatgaacgatttttgagaaattgccaatgaccatattcgttttcgacataaacataatctgcatgctgataaagcaaattaattacacgttcagaaataacagtatcattatgattaaaatagaatgttaaatcatgaactactaaataaacattacctttcatattttcctcacttataattggtcgaggcagtagggatcgaacctacgacctaggacttagaaggtccttgctcttccttctgagctatgccccgtaattggggtgaccgatgggagtcgaacccatgactacgagaatcacaatctcgagttctaccaactgaactacggccacattaatacctactccaacaatcaagatgtcttcacacgaaattaagagaagagtgatcagttcaacccctataatcgcgtcaagtagatattaatgtgacagttgtcacaaatttggcggacgtgataggattcgaacctataaccaatcgcttaacaggcgatcgctctgccattgagctacacatccaaattggtggggagtggtggagtcgaaccacccgagtcgcaatgacaatggatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccgtggcaggatttgaacctacgacattctgctcccaaagcagacgctctaccaaactgagctacacggagtaaattaaattgaagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttggccattctcgcgctgggaataaaggactcgaacctttgcatcctggaatcaaaatccagtgccttaccaacttggctaattcccaattattaacaaaggctcttaagcaagaacccttgatgatagagggtattaatcagtgcgatatgagttaataataacaaataattcttaaagcatatttaccatttataataatacatatttacgatgcattcaagacccaaaggattcttgaaaatatcatattcaagaggacctttttctgtttcaataaagaaatcaaaatttactgtattaaatttacgttcttccttcactaatttaacttgagaagatgaacggtcaatgtaaaccttttcaacttcaaaacatgttaaaatgccataatcatcaatcaaagctttagccgcgtcttgatcatatttatatccattttcaatggatgatactttagcataaagaatcattatcagccttcatcaacaatagtatgagtattggcatttacgatttgccaccagtcaaagcgattagaacccatcggtttgttttcattttctttgataatgtcacggagttcatcttcagagaatgctttagcgattaaatcggtatacccaccacgtggataataattatcacctgcaaacaaaaggaaatttaccttcccggaaggaacatacgcttccttaggatacttgtttcctgcgtggtcaaccacttcaatataacggtaaggaatatcggttctttcaacccattgccatgccgctgcagggcaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaaaacattttctgccgtagtcaataatccgcatataaatccaacaaacattgaaaaactgaaagcggaagcagaaattgcaatagcaacatttcgaattaattcacaacgcttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttgtagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactcttgaataacatatagtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgtccttcgtcatcaaaaacaaacacacccttaattgggcttttaccgttaagatagcaaaatgcttgttccataatcgtgattacttctgatttagtcagatttaaattagtctcacgatcatagtcaattccttcaaactctttacgagttaagcaaggatagtcagtgttttctgcaaatacgccccatgcataagccaatgcatccttaataggaccagcaagttggtatttaactgcagaataattgctcatgataaaatcagcagtagtatcttttccactacgctttacaccgcttaaaaagattagtttcatgtgtttctcctcaaatttagttaagattataacacatgaaactgaagcattaaacttccgctataatttttccatctttttctacttgaaaatacgtataaggaatcgttgctgtacatactaaagccgggtctgaatcttctgtgtagctaaattctacttcagacaggtcagaaacccaaggcttataaaaatttattgacatcacgatttcagttttgctattatctaaaatgtaaagcgtaatgtattcaggacctgttttttgggcagtattttcacctgtaagatagttgctagttcctagcatccattcatacattcctatccatgacttaagttcttcatcaactataaatctcacgatgagtggatcgtactcaaatgtagcacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataactgttggtggtataatgggtctaagtcccttccattcaattccatttagaacaaacaacagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccaggtatatatgccttaatcatttggtctgcacccctaaatcctttcacttgactccaatcaatttttaatttcgttttattagtaatagtaggtgtatttgaatattgctttaaaagctcttctaggaattgctggcgagctttaggtggaatatagtgcaagttcaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcgcgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgattcctctttcttcagcaaattgctttccggtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgttaaaattctaaattttattccacgcttttcagctaaagcttgagctgctttccatttgtcagtattaacggaatatgtataaatttcattcataaatcttttcttcgctgcagttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgttgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctggaggttctggcagtaattctaggtcatcctctgatactactgaaccgacggatcctcctgctccagtaagaaaaactctagttaaaaattacacaaaaactatagttggaaattggagtcgttgggctaataaattaagaagctatgtgtatgagaggtcatagatgtcaggattaagttatgataagtgtgttactgctggccatgaagcatggcctccaacagttgtgaatgccacacaaagtaaagtattcactggaggaattgctgttctcgtagcaggtgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacgtttgctgaaataaaacaaaacctcattgaatggcttaatggccaaaatgaatttttggattatgattttgaaggctcaagattaaacgttctgtgtgaccttttggcttataatacattgtacattcagcagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattacaattcctcgcggaactcgctttttagcatatgcaaaagatacttctgttaatccatataactttgtatctaccgaagatgttattgctattcgtgataaaaataaccaatattttccacgattaaaattggcccaaggacgtatagtaagaactgaaatcatttatgataaattgacacctattatcatttatgataaaaatattgatagaaaccaggttaaattatacgttgatggagcggaatggattaactggacgagaaagtcaatggttcatgctggttcaacatcaacgatttactatatgcgtgaaactattgatggaaacactgaattctattttggtgaaggtgaaatttctgttaatgcttctgaaggagctttgaccgctaattatatcggaggtctcaaacctactcagaactctacgattgttattgagtacattagtactaatggtgctgacgcgaacggagcagtcggattttcatacgcagatacattaacaaatataactatcatcaatattaatgaaaatccaaacggtgacccagattttgttggggcagatggaggcggtgatccagaagatattgagcgtattcgcgaattgggtactattaaacgcgaaacccagcaacgatgcgtaactgcgactgactacgatacattcgtttcagagagatttggttctattattcaggcagttcagactttcactgattctactaaacctgggtatgcatttattgctgctaaacctaaatcaggtctgtatttaactactgtacagcgtgaagatattaaaaattatctcaaagactataatttagctcctattacgccatcaattatttctcctaattacctttttattaagactaatttaaaagtcacatatgctttaaataaactacaagaatccgagcagtggcttgaaggtcaaataattgataaaattgatcgctattataccgaagatgtagaaatttttaactcgtctttcgctaaatctaagatgttaacttatgtagatgatgcagatcattctgtcattggttcatcagcgactattcaaatggttcgtgaagtacaaaacttctataaaacacctgaagcaggtattaaatacaataatcaaataaaagatcgttctatggaatctaatacgttttcatttaattctggacgaaaggttgtaaatcctgatactggtttagaagaagatgtattatatgatgttcgtatagtatcaacagaccgagattctaaaggaattggtaaagttattattggtccatttgcttctggcgatgttacagaaaatgaaaacattcagccatatacaggcaatgattttaataaattagcaaattctgatggacgcgacaaatactatgttatcggtgaaataaattatccggctgacatgatttattggaatatcgctaaaattaatttaacatctgaaaaatttgaggttcagactattgaattatattctgacccaaccgatgatgttatctttacccgtgatggttcactgattgtatttgaaaatgatttacgtccgcaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaaaacagactcgggggaaaatctcccgagtgatcaatatcgttggattaatttaggatatacagcaaacaatagtttcttttttgatgatgctgatccactaacatcatacatcattagagtagctacagctgcacaagattttgagcaatctgattgggtttatacggaagagtttgaaacttttgctacgaatgcttacacatttcaaaacatgattgaaatgcaattagccaataaattcattcaggaaaaatttactcttaacaattctaattatgtcaattttaataatgacactataatggctgcattgatgaatgaatcgttccaattcagcccatcatatgttgatgtttcatcaatcagtaattttattattggtgaaaatgagtatcatgaaatacaaggttccattcagcaagtatgtaaggatattaaccgagtttatttgatggaatcagaagggattctatatctttttgagcgttatcaacccgtggttaaagtatctaatgataaaggacaaacctggaaagctgtgaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagtaatgcacctatagattctgacccgttatcaccaacatactcggaaagactttttgaacctgatacaatgactataactggaaatcctaaagcagtatgctataaaatggattctatcggtgataaagtttttgctcttattattggtgaagttgaaacattaaatgccaatccgagaacttcaaaaataattgattctgctgataaaggaatatatgttttaaatcatgacgaaaaaacatggaaaagagttttcggtaataccgaagaagaaagaagacgtattcaacctggatacgcaaacatgtcaactgacggtaaattagtttctctgtcttcgagtaattttaaatttttaagtgataatgttgttaatgaccctgaaactgtagcaaaatatcagttaatcggtgccgttaaatatgaatttcctcgtgaatggttagctgataagcattatcatatgatggcatttatagcggatgaaaaatctgattgggagacttttactcctcaaccaatgaaatactacgcagaaccgttctttaattggtctaaaaaatctaacacacgctgttggataaacaactctaatagagctgtagtagtttatgctgatttaaaatacactaaagttatagaaaatattccggaaacatcaccagatagattagttcatgaatactgggatgatggtgattgtacgatagtaatgccaaatgttaaattcacgggatttaaaaaatatgcgtctgggatgcttttttataaatcttctggtgaaataatttcttactatgattttaactatcgtgtgagagatacagtagaaattatttggaagccgactggagtatttttaaaagcatttttacaaaaccaagagcatgagactccttggtcaccagaagaagagcatggattagctgatcctgatttaagaccattaattggcacaatgatgcctgattcttatttgttgcaggattcgaattttgaggcattttgcgaagcatatattcagtatctttctgatggatatggaactcagtataacaatttacgaaatttaattcgtaaccaatatccacgagaagagcatgcgtgggaatatttgtggtcagagatatataaaagaaacatttatttaaatgctgataaacgtgatgctgttgcgagattctttgaatcacgtagctatgatttttattctactaaaggaattgaagcatcatacaagtttctttttaaagttctttataatgaagaagttgaaattgaaattgaatctggggccggtactgaatatgacataatcgttcaatctgattctttgactgaagatttagtaggacaaacgatttatacggcaacaggaagatgtaatgttacttatatagaaagaagttattctaatggtaaattgcaatggaccgtaactattcataatcttttgggaagattaattgctggtcaagaagttaaagcagaaagactccctagttttgaaggcgaaattattcgtggagttaaaggaaaggatttgcttcaaaacaatatagactatattaatagaagtagatcatactatgtaatgaaaattaaatccaatttaccttcttcccgctggaaatctgacgttattcgttttgttcatccagtaggatttggatttatagcaattacccttttaacgatgtttattaatgttggtttaactcttaaacacacagagacaataattaataaatataaaaactataaatgggattctggattgcctactgaatatgctgatagagtagctaaattaactccaaccggtgaaattgagcatgattcagtaacaggcgaagcaatttatgagcctggcccaatggctggtgtaaaatatcctcttcctgatgactataatgctgaaaatagtaattcaatatttcaaggtcaattgccttctgaacgacgcaagttaatgagtcctctatttgacgcatctggaacaacatttgcacagtttagggatttagttaataaacgtctaaaagataatataggaaatccaagagaccctgaaaatccaacacaggttaaaatagatgaatgattcaagtgttatctatcgtgcgatagttacttcaaaatttagaacagaaaaaatgttgaatttttataattcaattgggagtggtccggataaaaacactatctttatcacatttggaagatcagaaccgtggtcatcaaatgaaaatgaggtgggctttgctccaccttatccaactgattctgtattgggtgtaactgacatgtggactcatatgatgggaaccgtaaaggttcttccatctatgcttgacgcagttattcctcgtcgagattggggagatactagatatccggatccatacacatttagaattaacgatattgtagtgtgtaactcagctccttacaacgctactgaatcaggcgcaggctggttagtatatcgttgtttagatgttcctgatactggaatgtgttcaattgcatctttaactgataaggatgaatgccttaaattaggcggaaaatggacaccttctgttaggtcaatgactcctcctgaaggtcgaggagatgctgaaggaacaattgaacctggggacgggtatgtatgggaatatctttttgagattccacccgatgtatctataaatagatgcacgaatgaatatattgtggttccttggcctgaggaattaaaagaagacccgactagatggggatatgaagataatctcacttggcaacaagatgattttggattaatttaccgggttaaggcaaatactatccgttttaaagcatatttagattcagtttattttcctgatgctgcattgccaggaaataaaggatttagacaaatatcaataatcacgaatcctcttgaagctaaagctcatccaaatgacccaaacgttaaagctgaaaaggattattatgacccagaagatttaatgaggcattcgggcgaaatgatttatatggaaaataggccacctattattatggcaatggatcaaacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcagcgtaaaatggcagtagcaaatggcactggagcagatggtcaaattatccatgctactgggtattatcaaaaacactctattacagagtacgcaactccagtgaaagttggcactagacatgatattgatacctctactgtaggtgttaaagttattattgaaagaggcgaactcggcgattgtgttgaattcattaactctaatggatcaatatcagttactaatcctttaacaattcaagctattgattcaattaaaggtgtttcaggtaatttagtagtaactagcccatatagtaaagtaactttacgctgtatttcatctgataattctacatcggtttggaattattctattgaaagtatgtttggacaaaaggaatcaccagctgaaggtacatggaatatttctacatccggatcagttgatattccactatttcatcgcactgaatacaatatggctaaattgttagttacgtgccaatcggtagatggaagaaaaattaaaacggcagaaataaatattcttgtagatgctgttaattcagaagtcatttcttctgaatatgctgtcatgcgggttggaaatgaaacagaagaagacgaaatcgctaatattgcatttagtattaaagaaaattatgtaacggcaactataagttcttcaactgtcggtatgagagcagcagttaaagttatcgctacgcagaaaatcggggtggctcaataatgaaacaaaatattaatatcggtaatgttgtagatgatggtaccggtgactacctgcgtaaaggtggtataaaaataaatgaaaactttgatgagctttattacgagcttggtgatggagatgttccatattcagccggtgcctggaaaacttataatgcttcatcaggacaaacattaacagcagaatggggaaaatcatatgctattaacacttcatctggaagagtaactctacaacttcctaaaggaaccgttaatgattataataaagtaattaaagctagggatgtatttgcaacatggaatgttaatccagttactctagtagccgcttctggtgatactattaaaggatcatcgtcatcagttgaaattaatgttcaatttagcgatttagagttagtttattgtgctccaggacgttgggaatatgtcaaaaacaaacaaattgacaaaattattagttcagatattagtaatgtagcacgtaaagaatttttagtcgaagttcaaggacaaacagactttttagatgttttccgcggaactagctataatgttaataacatccgagtaaaacaccgtggtaatgaattatattacggcgatgtatttagtgaaaacagtgactttggctctcccggagaaaatgaaggagaattgattcctcttgatggatttaatattaggttaagacagccttgtaatattggtgacactgttcaaattgaaacatttatggatggtgtatcacaatggagaagttcatatacaagacgccaaataaaagtactggattcaaaactaacgtcaaaaacgtctttagaaggaagtatttacgttactgatttatcaacaatgaaatcaattccattttctgcatttggattaattcctggagaacctattaatcctaattctcttgaagttcgttttaatggaattttacaacaacaagctggaacagcaggatatcctctgtttttgtgtgaaggtgctaactcagatacgcaagcaggatgtatatctcttggtggtgaatggaaagaatcgaacacagattattctatagaatatgaagatggaaaacctgtcagtcttttatttgatagaaaatttgaatcaggtgatataatcgttataacatggtttaataatgatttaggaactcttttagaaaaagatgacattattgaattaactgatgaccgttatgttagtaaaggatcatctactgaagttactggggatgtagccttaacagattttgataaaatcggttggccaaatgttgaaaaagttgattcttatactagaacgtataattcaatatcatctattttcgacagcatttatcctgttggttcaatttatgaaaatgctataaacccaaataatccggtgacttatatgggatttggttcatggaaattatttggtaaaggacaagttttagtaggatggaatgatgatgttacggatccaaactttgctttaaacaataatgatttagattctagcggaaatccttcacatactgccggtggaacagttggaacaacatcggtgacacttgagaacgcaaatcttcctgcgactaaaactgatgaaaaagttttaattgaagatgaaaacggatcagttattattggaggttgtcaatatgacccagacgaaactggtcctatatatacaaaatatcgtgaagactacgcaacaacaaactcttcacatactcctcctactaatattagtaatattcaaccgtctattactgtataccgttggataaggattgcataatgagtttacttaataataaagcgggagttatttcccgcttagcagattttcttggttttagaactaagaaaaatgatatttcggttatgaataatcagccagtaggcgctgtaacaatttcacaaatagcaaaaggtttttatgacccgaatgtagaatctgctatcaatgatgttagaaatatggcagagcaaccggttggagctgtattagttaatataagcggcgtatctcctactggcgtgcaacaaaccgactattggtcatttgaaggaactgttactgatacttcagtcaaatcaggtgacccagttattgttaacatgtttggtattccagttaaagctactaatggaatgacttcaattgaatttactagtgctgttagaacagctctacaggaaatggttgtaaaatttattgcaattgattcatttgaagaccatcctactatagggaataaaatacaagttaagtatttagataaccaagaacatatcttagagcaatactctgataaaggaattactttcaaacaagaaataatttctccttctaaacccgggtatggaacttggcaattattaggtgcgcaaactgttacgctagatagtcatacacaacctacagtattttattattttgagagaatagcatgagtaacaatacatatcagcacgtatcaaatgaatcaaaatatgttaaattcgatcccactggatcgaattttcctggcactgttacgacagtacagtctgcattatcaaaaataagtaatatcggcgtaaatggtattcctgatgcaactatggaagttaaaggaatagcaatgattgcatcggagcaagaggttttagatggaactaataattctaaaatcgttacgccagctacattagcaacaaggttattatatccaaatgctactgaaactaagtatggtttaacgcgctattcaacaaatgaagaaacattagaaggctcagataataattcatcaataacgccacaaaaactgaaataccatactgacgatgtgttccaaaatagatattcgtctgagtcatcaaacggggttattaaaatatcatcaacacctgcagctttggctggtgttgatgatactacggcgatgactccgctaaaaacccaaaaactcgcaataaaattaatttcacaaatagctccttccgaagatactgcatcagaatctgtgagaggtgtggttcaattatcaactgttgcgcaaactcgtcaaggaactctccgcgaaggatatgcaatttctccgtatacctttatgaattctgttgcaacacaagaatataagggtgttatacgtttaggaacacaatcggaaattaacagtaatttaggagatgttgcagtaacaggtgaaacactaaatggtcgaggagctaccggttctatgcgtggagtagttaaattaacgacgcaagccggtattgcccctgaaggtgatagctctggagcattagcatggaacgcagatgtaattaatactcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggcgattggaataatcctggcgttcctgatatgcggggtcttttcgtcagaggagctggcacaggcggtcatattttaaatcaacgaggacaagatggttatggaaaggatagacttggcgtaggatgtgacggaatgcatgttggtggtgttcaagcacaacaaatgtcataccataaacacgccggtggttggggggaatataacagaagtgaaggcccatttggcgcgtctgtttatcaaggatatcttggaactagaaaatatgccgactgggataatgcttcatacttcactaatgatggatttgaattaggcggaccgagagatgcccttggtacacttaatcgtgaaggattaattggttatgaaactagaccatggaatatatcattaaactatattattaaagttcattactaaggattacaaatgattgaattaaaagatttaccttttgttgatagcgttcctgatgaaggtcaggaacgtatttcatggattaaaaatggtgaagaaatactaggagctagcactaagtatggaaacgatggatcaatgaatagaccaattgtttccgtgtttaaaaatgttgaggttcttgacgaaaatataggaattcttaaaactgccattgaaacatcgcagaaagatattaaaacaattcaaggagttttagatgtatcaggagatatagaagcactatcgcagatcagtgttaataaaaatgacatatcaaatttaaagacacttactaatgaacacactgatatattaactggaactaataatacagttgacaaaattattgctgatataggtccatttaatgatgaagaaaactctgtttatagaacaattagaaatgatttattgtggattaaacaggaattaggacaatattctggccaagacattaacggtcttcctgttgttggtaatgctagcacaggaatgaaacacagaataataacaaatagtacattattatcttcacaaggcattcgtttaagtgaattagaaaataaatttactgaatctgacgtaggatcattaactgttgaagttggtaaattacgtgatgaacttggtaataaaccagtagattttgggccaaatatttataatagattaaacaccatagatgataaacaaactttaataatttctgatatagcagaaattaaatcttctattggatacccagaaaatgtttctataataacagaaattaataataacaaaagtagcattgaagctattaataatgaattaaatcagagtgaaggtgttaaacagcgcttaacggctattgaaacttctataggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctataaaaacgaatgaaactaacattgcggcagtcacacatgaagtaaatacagctaaagacaatatatcctctttacagagcagcgttcaagctctacaagaagcaggttatattcctgaagctccaaaagatggccaagcttacgttcgtaaagacggcgaatgggtactactttctacctttttatcaccagcataacatggggccgcaaggccccaaaggattttaaatgtcaggatataattctcagaatccaaaggaactcaaagatgtcattctaagacgtttaggggctccaattattaatgttgagttaacacccgatcaaatttatgattgtatccagcgtgccctagaattatacggtgaataccattttgatggacttaacaaaggttttcatgtattttatgtaggagatgacgaagaaaaatataaaactggagtcttcgatttaagaggttcaaatgtattcgcagtaactcgcattttgcgaacaaatattggatcaataacgtcaatggacggaaacgctacatatccatggtttactgattttcttttaggaatggctggtattaatggcggtatggggacttcttgtaatagattttatggaccaaatgcctttggagctgatttaggatattttacccagcttaccagttacatgggaatgatgcaagatatgctctctcctattccagacttttggtttaattcagcaaatgaacagctcaaagtcatgggaaacttccaaaaatatgatttaattatcgtagaaagctggactaaatcatacattgatactaataaaatggttggaaatacagtaggatatggaacagtcggtccacaagatagctggtcattatctgaacgatataataacccagacaacaatttagttggtcgtgttgttggtcaagacccaaatgttaagcaaggtgcttacaataatcgttgggtgaaagactatgctactgctttagctaaagaattgaatggtcaaattttagcacgccaccaaggtatgatgcttcctggcggtgttacgattgatggacaacgcttaatagaagaagctcgattagaaaaagaagcattacgtgaagaattatacttgctcgatcctccatttggaattttggtaggttaatatggctacttatgataaaaatctttttgctaaattggaaaaccgcactggttattctcagaccaatgaaactgaaatactaaatccttatgtaaatttcaatcattataaaaacagtcaaatattagctgatgtattagtagctgaaagcattcaaatgcgaggtgtagaatgctattatgttccaagagagtatgtttcccctgatttgatatttggcgaagacttaaaaaataaatttactaaagcttggaaattcgctgcatatttaaattcatttgaaggatatgaaggagctaaatcgttctttagtaactttggtatgcaagtacaggatgaagttactttgtccattaatccaaacttgtttaaacaccaagttaatggaaaagaaccgaaagaaggcgatttgatatattttcctatggataacagcttatttgaaattaactgggttgaaccatatgatccattttatcaattaggtcaaaacgctattcgtaaaattacagcaggtaaattcatttattctggagaagaaattaatccagttctacagaaaaatgaaggaattaacattccagaatttagtgaattagaactaaatcctgttcgcaatcttaacggtattcatgatattaatattgatcaatatgctgaagtagatcaaattaattctgaagctaaagaatatgttgaaccttatgttgttgtcaataacagaggcaaatcttttgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcgataaattcacaagaagatgtggccaaggttgaaactattctacctcgtataaatttgcatttagttgattttagctataacgctccatttaaaacaaacattttaaatcagaatttactgcaaaaaggtgcaacttctgtagtatcgcagtataatccatctcctattaaaatgatttatgaattgagtatctttactcgctacgaagatgatatgtttcaaatagttgaacagattcttccatattttcaacctcattttaatacaactatgtacgaacagttcggaaatgatattccatttaaaagggatatcaaaattgtattaatgtctgctgctatagacgaagctatagatggagataatttatctcgtcgtagaattgaatggtcattaacatttgaagtaaatggatggatgtatcctccggtagatgatgcagaaggattaattcgtactacttatacagattttcacgccaatacaagagatttgcctgatggcgaaggtgtttttgaatctgtcgatagcgaagttgttcctcgagatattgacccagaagactgggatggaacagtaaaacaaactttcactagtaatgtaaatagaccaacaccgccagaacctcctggcccaagaacatagaggttattatggaaggtcttgatataaacaaacttttagatatttctgatctccccggaattgacggggaggaaattaaagtatatgaacctctgcaattagtagaagttaaaagcaatccacaaaaccgcactcctgacttagaagatgattatggagtagttcgtcgaaatatgcattttcagcaacaaatgctaatggatgcagccaagatttttcttgagacagcaaagaatgctgattctcctcgtcacatggaagtatttgcaactcttatggggcaaatgactacgacgaacagagaaatactgaagcttcataaagatatgaaagacattacatctgagcaggttggcactaaaggtgctgttcctacaggtcaaatgaatattcagaatgcgacagtattcatgggttcaccaacagaattaatggacgaaattggtgatgcttacgaggctcaagaagctcgtgagaaggtgataaatggaacaaccgattaatgcattaaatgatttccatccattaaatgaagctggaaaaattttaataaaacacccaagcttagcagaaagaaaagatgaagatggaattcattggataaaatctcagtgggatggaaaatggtatcctgaaaaattcagtgattaccttcgtctacataaaatagtaaaaattccaaacaactctgataagcctgaattatttcaaacttataaagataagaataataaaagatctcggtatatgggtcttcctaacttgaaacgagctaatattaaaacacaatggactcgtgaaatggttgaggaatggaaaaaatgccgagatgatattgtttattttgcagaaacatactgcgccattactcatatcgactatggtgtcataaaggttcaattacgtgattatcagcgtgatatgctcaaaataatgtcatctaaacgtatgactgtttgtaatctatcgcgccagctcggtaaaacaactgtagtagctattttccttgcacactttgtatgttttaacaaggataaagctgtaggtattcttgcgcacaaaggctcaatgtctgcggaagttttagaccgtactaagcaagcaattgaattgcttcctgactttttacaaccaggaattgttgaatggaataagggttcaattgaactagataatggttcttcaattggcgcttatgcttcctctcctgacgcagttcgtggtaactcgttcgcaatgatttacattgacgaatgcgcatttattccaaacttccatgattcctggcttgctattcagccagtaatttcatctggtcgtcgttcgaaaattattattactacgactcctaatggattaaatcatttttatgatatttggactgcagccgttgaaggtaaatctggatttgaaccatatactgctatttggaattcagttaaagaacgtctttataacgatgaagatatttttgacgatggatggcaatggagcatacaaaccattaatggttctactttagctcaatttcgtcaagaacacaccgcagcgtttgaagggacttctggtacattaatttcaggaatgaaattagctgttatggatttcattgaagtaactccagatgatcatggttttcatcgatttaaaagccctgaaccagatagaaaatatatcgcaactctagactgctcagaaggtcgtgggcaagattaccacgctttacatattattgatgttaccgatgatgtgtgggagcaggttggtgttttacactcaaacactatttctcatttaattctacctgacatcgttatgcgttatttagtagaatacaatgaatgcccagtttatattgaattaaatagtactggtgtgtcagttgcgaaatcactttatatggatttagaatacgaaggtgttatctgcgattcatatactgatttaggaatgaagcaaactaaacgaacgaaagcagtaggatgctctacattaaaagaccttattgaaaaagataagcttattattcatcaccgtgcaactattcaagagtttagaacgtttagtgaaaaaggcgtgtcttgggcggctgaagaaggttatcacgacgatttagtaatgtctttagtaatttttggatggttatcaacacaatcaaaatttattgattatgctgacaaagatgacatgcgactagcatctgaagtgttttcaaaagagcttcaagatatgggtgatgaatacgctccagtcatatttgttgattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctctggccggtaaattccagtggggtcctgcttttcaaattaaacaggttacaaatgaagtagatttagttaatacttttggtcaacctacagctgaaactgctgactattttatgtctgcaatgaatttcttacaatacggaaatgatttgcgagttgtgcgtgctgtcgatagagataccgctaaaaactcatctccgattgccggtaatattgaatacactatttctaccccaggtagtaactacgcggttggagataaaatcacggttaagtatgtttcagaagacattgaaacagaatgtaaagttaccgaagtagatgctgatggaaaaattaagaaaattaatattcctactgcaaaaattatcgctaaagcgaaagaagtaggcgaatatccagaattaggttctaactggaccgcggaaatttcttcgtcttcctctggtttagctgcagtaataactcttggaaaaattattactgattctggtattttattagctgaaattgaaaatgccgaagctgctatgacagctgttgactttcaagcaaatctcgaaaaatatggaattccaggagtagtagctctttatccaggcgagttgggtgataaaatcgaaatcgaaatcgtatctaaagctgactacgcaaaaggtgcttctgcattactcccaatttatccaggtggcggaacacgcgcatctactgccaaagcagtatttggatatggaccacaaactgattcacaatacgctattatagttcgtcgcaatgatgctattgttcaaagcgttgttctttcaacgaagcgtggtgaaaaagatatttacgatagtaacatctatattgatgactttttcgcaaaaggtggttcagaatatattttcgcaactgcacaaaactggccagaaggcttctctggaattttaactctgtctggtggattatcgtcaaattctgaagtaacagcaggagatttgatggaagcctgggacttctttgctgaccgtgaatctgttgacgttcagttgtttattgcgggttcttgtgccggtgaatctttagaaacagcatctactgtccaaaaacacgtcgtttcaattggggatgctcgtcaagattgcttagtattatgctcaccaccgcgtgaaactgtagttggaattcctgtaactcgtgctgtcgataacttagtcaattggagaactgcgacaggttcatacactgataataactttaatatcagttcaacctacgcagcaattgatggtaactataagtatcagtatgacaaatataatgatgtgaatcgttgggttccattagcagctgatattgctggtttatgcgcaagaactgataacgtatctcagacttggatgtctccagctggttataatcgtggtcagattcttaacgttattaaactggctattgaaactcgccaggctcagcgcgaccgtttataccaagaagctatcaacccagtaactggtacaggtggtgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccagtacttacagggaattaaagctctcggtggaatttatgaatatcgtgtagtttgcgatacaacaaataacactccgtcagtaattgatagaaatgagtttgttgcaacattctacatccaacctgcacgcagtataaattatatccaacttaacttcgttgcgactgctactggtgcagatttcgatgagttgactggtcttgcaggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacgttccaatgtaaagctactgctttaccagctggtattgtagaaaaaattccagtcggatttatgaaccgtaaaattaacgtagcaggcgatcgtacattcgatgactggactgttacagtaatgaacgatgaagctcatgatgctcgccagaagttcgttgattggcaaagcattgctgcgggacaaggaaacgaaattactggtggaaaacctgcagagtataaaaagagcgctatcgttcgtcaatatgctcgtgacgctaaaacagtaacaaaagaaattgaaattaaaggtctgtggcctactaacgtgggtgaacttcaattagattgggattcaaacaatgaaattcaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagctccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtcgataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgtgaaattataacagaaactgaagctggcacaaaaatagttaaaggttacaaagaatattttatatatgatactgcccatgagtcatatgcatgtgatggtagaatgtatgaagctggcacaaaaataaaaattcctaaagctgccgtagtttatgcccattctggattagtcgattgttgcggtaaaaatatcatcgggtatttacatcgtgccgttaaacctgctaaccaattaaaattactagaagatgctgtagtcatttatcgtattactcgtgctcctgatcgtcgtgtttggtatgtagacacaggtaatatgcctgctcgtaaagctgccgagcacatgcaacatgtcatgaacacgatgaaaaaccgtgtagtatatgatgcatcaacaggtaaaataaaaaatcaacagcataatatgtctatgaccgaagactattggttgcagcgccgtgatggtaaagctgtgacagaagttgatactcttcctggtgctgataataccggtaatatggaagatgttcgttggtttagacaagctctttatatggcattacgtgttcctctttcacgcattccgcaagaccaacaaggcggtgtgatgtttgattctggaactagcattacacgtgatgaattaacgtttgctaaatttattcgtgagttacagcacaagtttgaagaagttttcctagatccgcttaaaacaaatctgttgcttaaaggtataatcacagaagatgagtggaatgatgaaataaataatattaagatagaatttcatcgggatagctactttactgaactcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattctttgctgaagccatggctgcaagaacgattgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagatgacgaagacgaggatgatgaataatgcttctgatccctgaaactcatgaattagttctcgagaatgtcgaagcacttattcctgaagcacagggtcgctttgacgaattgtcttccgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattacacgtaccaaagaccgcaaaacgcgtgaacgtaatgcatttcaaaccaccgggctgtctaaagcaaaacgtagacaaattgctcgcaaagctaccaaaacgaagattgccaatccagcaggtcaatctcgtgctcagcgtaagcgtaaaaaagctcttaaacgccgtaaagcattaggattaagctaatgaatgaaccccaattgctaattgaaacttggggtcaacctggcgaaattattgatggcgtgccaatgcttgaatcccatgatgggaaagacttaggtttaaaaccgggtttatacatcgaaggaatattcatgcaagcggaagttgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccatggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgaacacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgctgcaggtcagacttctggcgcagtaactcagattggcccagctgttatgggtatggtacgtcgtgctattcctaacctgattgctttcgatatttgtggtgttcagccaatgaacagcccgactggccaggtattcgcgctgcgcgcagtatatggtaaagatccaatcgcttccggcgctaaagaagcattccacccaatgtatggtccagatgcaatgttctctggtcagggtgctgctaagaaattcgctgctttgaaagcaagtgatactcttgaagtcggaactatttacactcacttcttccaggaaactggtacagtatatctgcaagctacagcagctaaacaaattgattcaggcgcatctgacgcagacaaattagatgctgaaattaagaaacaaatggaagctggtgtactggtagaaatcgctgaaggtatggctacttctatcgctgaacttcaggaaggtttcaacggttctaccgataacccatggaatgaaatgggcttccgtatcgataaacaagttatcgaagctaaatctcgtcagctgaaagctgcttactctattgaattagcacaagaccttcgcgctgttcacggtatggatgctgatgctgaactgtctggtattctggctaccgaaattatgctggaaatcaaccgcgaagttgttgattggattaactactccgctcaggttggtaaatctggtatgaccctgactccgggttctaaagctggtgtatttgacttccaggacccaatcgatattcgtggtgctcgctgggcaggtgaatcctttaaagctctgttgttccagattgacaaagaagcagttgaaattgctcgtcagactggtcgcggcgaaggtaacttcattatcgcttcccgtaacgtagttaacgttctggcttcagttgataccggcatttcttatgctgcacaaggtctggctactggctttaacactgatactaccaagtcagtatttgctggtgttctgggtggtaaataccgtgtatatatcgaccagtatgctaaacaggattatttcaccgtaggttataaaggtccgaacgaaatggatgctggtatttactatgctccatatgtagctctgactccgctgcgtggttctgatccgaagaacttccaaccggtaatgggattcaaaactcgttacggtatcggtatcaacccatttgcagaatccgctgctcaggctccggcttctcgcatccagagcggtatgccttctattctgaatagccttggtaaaaacgcttacttccgccgtgtatatgttaaaggtatctaatctttgacgatttaagggaccttcgggtccctttagttgtttttatggtataaataaatcatataaactgaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaactggtgctacttacgccggcgaagctggatatgtagaccgagaacaaatcacagaattaacagaagagtctaaattaactctcaataagggcgatttattcaaatataataatatcgtttataaagtattagaagatacaccatttgctgatattgaagaaagcgatttagaattagctcttcagattgcaattgttcttttaaaggttcgtctattttctgacgcagcgtcaacaagcaaatttgaaagctctgatagtgaaattgcggatgctagattccagattaataaatggcaaaccgcagttaaatctcgtaaacttaaaactggtatcacagttgaattagcacaagatttagaagcaaatggattcgatgctcctaatttcttggaagatttgcttgcaactgaaatggcagatgaaatcaataaagatattctgcagtctttgattacagtgtcaaaacgctataaagttacaggaattactgatactggattcatcgatttgagttatgcatctgcacctgaagctggtcgttcattataccgaatggtatgtgaaatggtttcgcatatccaaaaagaatcaacttatacagcaacgttctgtgttgcttcagctcgtgctgctgcgattcttgctgcatcaggttggttaaaacataaaccagaagatgataaatatctttcacaaaatgcctatgggttcttagctaatggtttaccgctttattgcgatactaacagcccattagattatgtaatcgttggtgtagtagaaaatatcggtgaaaaagaaattgttggatcaattttctatgctccgtatacagaaggtcttgacttagatgaccctgaacatgtaggtgcatttaaagttgtagttgacccagaaagtttgcagccatctatcggtttattagttagatatgctttatcagcaaatccttacactgtagcaaaagatgaaaaagaagcaagaataattgatggtggagacatggataaaatggcgggtcgttcagatttgtctgttttattaggtgttaagctaccaaaaattatcgttgatgaataaaacaaagggacctttcggtccctttttatttaacttaccaattcaatccaagccggacgaagtacatcttgtaccattttaactaattcctttttaaccaaagaaggattatctgcttgagttagagtaataccttcacgagaagtttcttccaaaatatcttgaacagttagtcccatcacctttccaaaatccttcggaccaatttcaccaattttagaaataacgttatttactcggtttagtgtaacgtaacaagctaaaatccccaccaatttgttatcagcttctgacagttcaactttagctttaataggcttatcagactttttcttttcactaaatttagaattcttgcatttgatggctacacgatttccattatgaagccaagaaggataacaaggtttcaatacatatccttcagcggtaaatacttcgcctttggcttcagctttccaaacacatttgttagcgtcaactaatccagcatggtctactgtaaaattataagacggaacaacagaatccaaatcatttggaagtttaataagatcttcaaatttaccacgacccaaaagtggagcgattttaaacccaaatgaattacaaaacgattccatcatgtaatcatcaacataagttacatcaccactttcggtagtgacaataatgtcaaatacataaaaatctttatcgccataatcaacattcttctgaatgccaggtccagcgaattcgccaaaaacttgataagtcacaacagctgaagtttccataatatcttgtactgctttaatggaatcagcgtaattctttagaataatttcatacccaaagaaatcttcagcaggaagaatcggtccagtacgtttagcgcaagttactttatcacgctcaataatcaaagaaaagtttgttccatgaattttttcacgagctacccattcgccgccagtcaatcccaagctataaagtttttcaataaatttagagttgtaatgattttcaagactgctatactttttaaacataattaatcctcaaaatgtaatttctaaccaatcaccatcacgctgatcactattgactttaaaatcaaatccttcttttctcagccaatcaccaatttcttcagtaatcaatttatcgcgagcagtacaataataactaaaatatgttttaccttgttcagctgctttattagcaagttctgaaaaatctttaataaaacactctagcttaaactgtttactttttaatgctttttcacgtaattgattagcaaaagattcattttcataaagatcatactgttccatttttcacctttttattgatatgtctttttctatagacaactttttctcgagtttcaaatttattcttagcagtcatagctcgagcccataatacagccacttcttttgcctgtaagtttaattcacgagcaatttcaatgaatgactttccagactcatgaagagtaaacaccacaacctcagttctcataatcaatctcatgttatcgagttggtgccattatatacatcaatctcaagttgtgttttgtatgctttcaaaatgaagaaaggggccgaagccccttatgattatggataggtatagatgataccagtttctaaagcagttttatggatgatgtatccattacgcgattcttgaacatcaacttctggatagtctttcatcatcttctggagagtgtaacgatgcaagtagtacttactatctggatcgtcagttttccaatctttaccttcttcagtcattttttggatttcatccataacccaccaaccgcaccagatgtaagctgaagtacgatgtggaagaggatgaacataaggtaattcaccttctggctctggagcaactttatcagttacctgaacttgaccttctgctgtaatagttttgctatcataatcagcagcagtaacagttgcagtaacttcaatagtttggcttccaacagatgacgtatcgacagtatacacgttagttgatccttctacaggagaagaatctttcttccatgaataagcaatttgtgcttcttctggtgcatcagtgacattagcggtaaatgtggccgaagcatcttgctgaacattaatagaaggaggagtcaatgtaacctgtggattcattgtcttcttattaacagtcagtgatacttcattcgaagtaacttcttttgcgtcataatctgttgccgtcacttgggctacgcatttaattctttttactccacttgtagtaggagtatagctaaatgtagcgttagttgcttcgctcacaggagaatcatctacatgccactgatacgtagcagatgcgcctgatggttgagaagctaaagcagcagtaaattgaactggggttccgattactccagcagcagggctatcaggagttacagccaatgtagttgtctgagttttattttgaactgtgatagtagttgacgcttgggctgtttcagcttcagtatcaggaactggatttgttgcaactaccttaatagtcttttgaccggcaggaccttttagtacataactaaaagttgctgacgtttcttcctgcggagcgtcgtctacagtccaagcatatgtaataggtccatctccagtttgaccactgggtgtagcagtaaactgctgagtctgatctataactccagtaggtgttttaggagttatatcaactgtaaaagccataagttatccttattttaatgttacgaaagaagaattacgtgtttcacgaattagaactgatccgtcacggttaatgtaataaattaagctaaataatgtttggtgtgcagaagcatgctcaaaactagttgggtgagatttccaatccggagtttcagcgatccattgataaatccaccaaggaacagtacagaatcctggattttttccaatcaactgaagattcgggctaaagttttccggaagagtaaatacagacggcttttcagattcaataatctcagctacagcctgttcgaatttttcttcaacaaaaggagtatcttcaatcaaaacatcggtattttcaggaattttatccgtttctactacttcaattttaatgtcagatttaaccggagaatcaatcaaaagtgctgcttctggattgacttcttcatcgtcatattttaatccctctgcagcatcagcagcatcaattaagtctttaatagataacccatcagtctctggcataggttcactagcgagcttctggagggcttcttcaatatcaacaacgatattatcaaaagatttattctttttgacctttataccaaactgttcagcatattcagctaatttagctttagcttctttattatcatcaagagccttcagctctgcaatataatctttatctatcataatatttcctcagtataaatatagatatatttattacatggtatttagacatgactgacattaaagtacatttttatgattttagtcacgtgagaattgattgcgaagaaagtacatttcatgaactccgtgatttctttagctttgaagctgatgggtatcgttttaatccgaagtacaaatatggccactgggatggacgaattcgtcttttagattataatcgccttcttccattcggtttagtcgggcaaattaaaaagttctgcgataactttggctataaagcctggattgacccacagattaacgaaaaagaagaattatcaagaaaagattttgatgaatggctttctaaattagaaatctattcaggaaataaaagaattgaaccgcattggtatcaaaaagatgcagtgttcgaaggattagttaatcgtcgtagaattcttaatcttccaacatccgctggtaaatcgttaattcaagctttgcttgcgcgatattatttggaaaattatgaaggtaaaattcttatcattgttccaacaactgctctaacaactcagatggctgatgacttcgttgactatcgtttattcagtcatgcaatgataaagaaaattggtggcggagcatcaaaagatgataaatataaaaatgatgcaccagtcgttgttggtacatggcaaactgtagtaaaacaaccgaaagaatggttctcacagtttggaatgatgatgaatgatgaatgccatcttgctacaggaaaaagtatttcatctatcatatcaggtttaaataactgcatgttcaaatttggtctatctggttcattacgtgatggcaaagccaatatcatgcagtatgttggaatgtttggtgaaatatttaagccagtaacgacttctaagttaatggaagatggacaagtaactgagctaaaaattaatagtatttttcttcgctatcccgatgagttcactactaaattaaagggaaaaacttatcaagaagaaataaaaattattacggggcttagtaaaagaaataaatggatcgctaaattggctattaagcttgcacaaaaagatgaaaacgcttttgtcatgtttaaacatgtatcacatggtaaagctattttcgatttaattaaaaatgaatacgataaagtttattacgtatcaggggaagttgataccgaaacccgcaatataatgaaaaccttagctgaaaatggtaaaggaataattatagtagctagttatggtgtattttctactggtatttcagttaaaaatctgcatcacgttgttttagcgcacggtgttaaatcaaaaatcattgtattacaaacaatcggtcgtgtattacgtaagcatggttctaaaacaatcgcaacagtctgggacctcatagatgactgtggtgtcaagccaaaatctgctaatactaaaaagaaatatgttcacttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgcgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaagaacatcttcaccgcacgggtggtcggccaggatacgaatatcctgacgcttaagattatgctttttcattaagaattgaatttccgtttcaaattcttcttcataattaaaagcatcatcaatgttatatctcattattttccagcctcaaatgctcgcatgtcttgaatatgcttaatagcaaatccacgtgatttaatagcatcaagagctccgctacagaaatctaataaaatcccccaatactgtaacgaggtatcaacctttaaaacatccttatcagctgatagaactgtcttcatttctgatttctcgtaacgatccatactaaattcatcaccatctcctcgtcccgagtagtagtctaatttagctttaagagcaacttttttctgtgcttcaattctaagcatttcctttttaatacttgaatgcttattaagccatttactatataacatcacattattagctgcttcatactgtaatttagtcgaatctataaacacatctttcttcaattcttcttgaagatcttctaatctcatattgttctctattcaattgttattggatggacttagattcattataccacgtttatacgtgaagcattatactctattactggaagccagttgtagttttatctgctcaatatcatcagggttatcgatgactgaaaagcgtatttctactatcaaagtataatcatcataaaccggtattacattaactgctaatttatcaatacgtggctcatagtttcttactgcgctttcgatattacgctcaaccgtgtcagcagtaagaggagtcatattctcaaaaagttggtcagataaatcgcatccaaattcagggtcaaacggtcttgaaccttttcttgttgtaataattcctaaaagactatttttaattgaccttaatccaagtgatcttgaaacgtctttgttccaatccattttcatctctgggtcaatatcagaataaagcttattaatatttgccattacaatagctcaaagaattctttgagtcctcttattacatgagcgtgagtttttccacactctggacatttaattggaacagccaaataaacagtaggctttaaaagcatatcttttatagctacaatatctgactctgtgatgatagaatataaatcttctagttccttttcatttaagtcttcaactggaatgctttccccgttagcatgaatcgtttctatacatgatactatcatgtgggctatatttttatcatcaaaaattttagggtatcggaatttaattttaatgtcacccagtgtataccaaaggtcttctggtgcatctatttgtgtatgtaatagatttatatgggttggtatttcagttccgcaggtgcacttccaggagttttcgtgattaacttctccaagagaatgcgcccataaatgaatcaacaatagttctgattcttggcgatttaaatcttttgcatttgtgcagtctttgattagctttttaacaattacttctacagaaccattatttttggcagtaataagttctagatattctttaagagtaaatgcgcgacagttgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagagcatcggtcaccacaagaacaaaaagaaataattactgatttaattgatgattattttggagactatccgaagacttggcaaccatttatatttttgcaggtatttgtaggttcaataggtaaaactaaagtaccagtcacatttgtatgtccaaaatgtaaaaaagaaaagacagttccatttgaaatatatcaaaaagaattaaaggaacctatttttgatgtagctaatgttaaaattaaattaaattttccttctgagttttatgaaaataaagcaaagatgattactgaaaatattcattctgttcaagtagatgaaatgtggtatgattggaaggaaattagtgaatcgagtcaaatagaacttgttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgagcgcggattcgtattaaaactgattgagaaggataaacaataatgagtatgttgcaacgccccggatatccaaatctcagcgttaaattatttgagagttatgacgcttggagtaataatagatttgttgaattagctgctactattaccacattaactatgcgggattctctttatggtcgaaatgaaggaatgctacaattttatgattctaaaaatatccatacaaaaatggatggaaatgaaataattcagatttctgtagctaatgcaaacgatattaataatgttaaaacaagaatttatggatgtaagcatttttctgtatctgtagattcaaaaggtgataacatcattgctattgaattgggaactattcattctatagaaaatcttaaatttggtagaccatttttccctgatgcaggtgaatctataaaagaaatgcttggtgtcatttatcaagaccgcacattattaactccagcaataaatgctataaatgcttatgttcctgatattccatggactagcacatttgaaaactatttgtcatatgtaagagaagttgctctagcggtaggaagcgataagttcgtatttgtatggcaagacatcatgggagttaacatgatggactatgatatgatgataaatcaagaaccatatccaatgattgtaggtgagccaactttaataggtcaattcgtccaagaattgaaatatccattagcatatgattttgtttggttgactaaatcaaacccgcataaacgtgatccaatgaaaaatgctactatctatgctcattcatttttagattcttcattaccaatgattactacaggaaagggtgaaaactctattgtagtgtcaaggtcaggtgcttattctgaaatgacttatagaaatggatatgaagaagctattcgtcttcagactatggcgcaatatgacggctatgctaaatgttctactgtcggtaattttaacttgactcctggcgttaaaattatttttaatgatagtaaaaaccaatttaaaacagaattttacgttgatgaagttattcacgaattatcaaataataattccgtaactcatctatatatgttcactaatgcaacgaaactggaaacaatcgacccagttaaggttaaaaatgaatttaaaactgatactaccactgaagaaagtagttcttccgataagtaataaagaagtttctattcctaagatgggtcttaaacattataacattttaaaagatgttaaaggtcctgatgaaaatttaaagcttcttattgattctatttgtccaaatttatcaccggcagaagttgatttcgtttctattcatttattggaatttaatggaaagattaaatctcgtaaagaaatagatggctatacttatgacattaatgatgtttatgtatgccaaagattagaatttcaataccaaggaaatacattttattttagacctcctggaaaatttgaacaatttttaacggtgagcgatatgttatctaaatgcttgcttaaggtcaacgatgaagttaaagaaattaattttcttgagatgccagcattcgttttaaaatgggcaaatgatatttttacaactttagcaattcctggccctaatggtccaataactggaattggcaatattattggattatttgaatgaaaaagccacaagaaatgcaaacgatgcgtagaaaagttatttcagataataaaccaacacaggaagcggctaaatccgcttccaatactttatctggacttaatgacatttctacaaaattggatgatgctcaagctgcttctgaattaatagctcaaaccgttgaagaaaaatcgaatgaaataattggagcaattgacaatgtagaaagcgcagtgagtgatactactgctggttctgagttaattgctgaaactgtcgaaattggcaataatattaataaagaaatcggtgaatcgctcggaagtaaattagataaattaacgagtttactcgagcaaaaaatccagacagccggaattcaacaaacaggaactagtttagctacggttgaaagcgctattcctgttaaagttgttgaggacgatacagctgaatccgtgggtcctttattaccagctcctgaagcagttaataatgatcctgacgctgattttttccctgcccctcaaccagttgaacctaagcgagagtcaccggaagaaaaacagaaaaaagaagcatttaatttaaaattatctcaagctttagataaattaacaaagactgttgattttggatttaaaaaatccatttcaattactgataaaatatcaagcatgctatttaagtatactgtcagtgctgctattgaagctgctaaaatggttgcattaataatggctgttgttattggaatagacctactgatggttcattttaaatattggtcagataaattttcaaaagcctgggatttgtttagcactgattttaaaactttttcaagcgaaaccggaacttggggtcctttattacagagcatctttgaatctattgatgaaattaaaaagttctgggaagcgggagattggggcggtttgacggtagctattgtagaagggcttggaaaggttctttataatttaggagaacttattcagcttggaatggctaaattatcagcagcaattcttcgagttattcctggtatgaaagatactgctgacgaagtagaaggaagagcactggaaaatttccaaaattctactggagcatctctcaataaagaagaccaggaaaaagttgcgaattatcaagataaacgaatgaatggagaccttggtccgatagcagaaggactagacaaaattgcgaactggaaaactcgtgcatctaactggattcgtggtgttgataataaagaagcattgacaactgatgaagaacgcgcagcagaagaagaaaaattaaagcagctttcaccagaagaaagaaaaaatgctttaatgaaggctaatgaagcccgtgccgcgatgattcgttttgaaaaatatgctgattcagctgatatgagtaaagactcaacggttaaatcagttgaagctgcctatgaagaccttaaaaaacgaatggatgacccggatttaaataattcaccggcagttaaaaaagaacttgctgctagattttctaaaattgatgctacttatcaagagctcaagaaaaatcagcctaatgccaaacctcaaacttctgctaaatcgccagaagcaaaacaagtccaggtaatagaaaagaacaaagcacagcaagctcctattcaacaagcatctccttcaatcaataatactaataatgttattaagaaaaatactgtcgttcataatatgacacccgtaacgagcacgactgctcctggtgtatttgatgcgactggagttaattaaggaataatatggcaattgttaaagaaataactgctgatttaattaaaaagtccggtgagaaaatttcagccggacagagtactaaatcagaagtagcaactaaaacatacactgcccagtttccaactgggcgtgctagtggtaatgacactacaggggacttccaggtaacagatctatataagaatggattattatttactgcatacaatatgtcatctagggattctggaagtcttagaacgatgagatctaactactcttcttcatcttcgagtattttacgtacagccagaaacactatcagtaatacagtatcaaaactatcaaatggactaatatcagataataattcaggaacaataagtaaagttcctgttgcaaatattcttttacctagatctaaatctgacgtcgatacgtcatcacatagatttaatgatgttcaagatagtcttattacaaaaggtggaggtactgctactggtgtgctaagcaatatggcttcaaccgcagtatttggagcgctggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatctagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgataaaacacctaatggtaactttaacggattagctattgctccaaatctccctagtacatttactctcgagattactatgagagaaattatcacgttaaaccgtgcttctttatatgcggggactttttaatgtattctttagaggaatttaataatcaagcaataaacgcagatttccaacgtaataatatgttcagctgtgtttttgctacaactccatcaactaaaagctcttcgttgataagttcaattagcaacttttcttataataacttgggcctaaattcagattggttaggattaactcaaggcgatattaatcagggaattactacgctaattacagctggcacacaaaaactgataagaaaatcaggggttagtaaatatcttattggtgccatgagtcaacgtacagttcaaagtttattaggctcatttacagttggtacatatttaattgacttctttaacatggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggctgatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtcatgcaggctggagcagttgatagacaagctgcgcttgaatggcttgaatctgctgctataaatggtattcaaagcgttctcggaaatagtggaggtgtcactggactatctaattcgctttcacgacttagtagattagggggaactgcaggaagcatttcaaatattaacactatgacaggaattgtcaattcgcaaagtaaaatattaggagcaatataacaatggggacctttcggtccccatatttttatttacggaatgaaatgaaagcagcaactgaagcaactaaactgtcttcaatataaacttcaatttttaccggagcttctgactcaaatttacctgttactacaccctgaaaaatactttcagtctgttctggctttgaaaaattttcagaaggaaaaattccgaactttttatctgttccaaaaattttgataaattcatcgtaaactgcttcattaaaagcattatcagcaggaataacgccttcaactacaagttcttgacctaaaaagcgcaaagaagatttcattttgtgttcctcatgttatgtcagtaagactactataacacaacacgagggacttgtaaactacatcttgaactttttagacattccgttgatgttaaccaaagaagctaagatttgagaaacttcgttttcctcttcttttgattcttctacaaggaattgattaaatccagccattggacgaacttcaccagtttccattagatggtcgccatcatatactgattcttctaattgttcagaaggaggaacgattgtaccttcgattagatacttgttataagcagtttctttcataaagtaagtacttactttattaatcttcagtaaaattccacgtggtagaataacttcagcttctgacggaaatcctgataaatgacccggaacgataactttgattcgctcagctcctttaattaccatacccacgctagtttcagcatcttcattagcatatgtagaatgactacccatatgcatcaaatcttctgcatcaacggaaccttctccttcaccagaaaatactgcgccggaatcatctagagccatatagtttttaccatgctcaccgaagatatttggtttaagcgatgtggatacgaagttcttgaaatagaacattttattttcaatgttatgacgcaaagttttaaaggtaacttcttgtccacggtaaagtgtagttcctggaggaagaactgaacctttagcgaatgcagaatcaagcgtctcaatatgtttaatagctcgttccatatattcttcacgggtagaatctggtttacccaaaaggaacgagttcatttcaacatatgaatctgcacaataatcttcaattacatcagattcagcttgagttaatccttttggagttacttcagtgcttgcgtattcatatgcctgagcagcagattcattaatcaatttataaatgccattcatgacaaattgaataatagctgtcttttcatctggcgtagctttagaacctttaaccaaatcattgataattttcttaataacatcaaagctattagaaatattaatatcagcaagatcgcttaaaattttatcagtcttataatcaaagaattctttattctttaaatattcttgagaaccttgatatgttatatcgctctgtaacttgataaatggatcacgtaaacgtgcatgggctaatgcaatatgatttcggaagctttcgagttcataatcactagatttaaaacgagaagcgcttctcataccgcctatagctcctttgctgaagtttgaaccaatttgaataacgccagagttcattggtccttctgctttatacaccggaactttagattcaaactcttgatatttcttagcagcgaagctatcaccctgaagtgaagcatcaacagtagaatattgagcttgtgctgctaatcgacgactaattttagttttctgaataacagcttggtccgtgcgcttatcattttctaaagcaatagaagcagcaacagcaacagctttaggaacagcattacctgttttaacatctacataaacatcaccaacctttgattcaacttttgtgaataactcagttgaaataggaggtacacctggaatgtcttctaaattggcatttttacgataaaccataatatatgcgtactttttatcataatcccagatttcctttaaaagaacatatcgacctgctcctttagtacgtactaaacggtcagcaataacttgcatttgacgagcagcgccatttgttttactctttagtacgcggaataagcatgcatcaattttatactgtttcattgtttgaagagcagtatcaaaaacagcgttaatgacgccaattggatttccacccaagtttctaagtttaaccagtgataatttctcgttgacacctatcattacgatatgcatcattttatcgcccggcttaacgtttttatttgtatcacctccagaggtgtatgtacaaaatctaaatccaggaagcacgctttcttcgccggcttgaatagcaaaaatttgaggtattttatgcttaggatttaagttaacaaccggcgccgaagcgccgtcaaataattctgtaataagttccatgatttatccttgaacgaacttgtaaggcatgtttgtaatatctatgcaagacgcaataattccaagagatgattctactttctgtttaacatttgatgaaacaaatgatgcaaagtcaactctatcttctatatcacctgtcattgtaactacttcgccggtttccattaaacggtcaccgtcataaattactgattcggtgagttcttcggtggtcataacttcagcttgaataagcttgttgttagttttgactgttccatcattgtaagatgcatcagttattttattaactttgaccattaatccacgtggcaaaatgacttccatttcatttgaaggcgctaaacttccaccgggtaaaacaacattgactttatcagccccagtaataacccatccaattccgactaaattatcgctagaattaacaagcccttcatcatttttatcgatagaaatgtttagacgcttttcatctggtaaaacaccaacagctgaatcagtcatccaagtaccaaaaatgtttggatataatgatgttgatacaaaatttctaaaataaaaaactcgattttttaccattgcttcgtatattgaaggtaacattcgttgtgaacgatacaaagtaataccttttggtaatcgttcaccatttttaaaggctgaatctaaattatcaatagctttttctatgtcagatgctgtcaaaatacttgtacgctcatctggattatataatcccaaaagagcattatttatgtctacatatcctgaacctacgtattcacgaattccgcgtttttgtgctggtgtgtatttagatgaatctttattttcgactataggatgtaatgaccatccagctgtaagagcatatccacgtaattctcttcgaataatctttgtttttattgcattccaagaattttgtactaactcatttgcagcatcttggtttaaatgcgaatgtttgttaatatttctttcaaaccaagcacctttatatttttctaaagtatcatcgacgatagaagcaatagtttctaaagtttttattgaagtaatagattcttttcgtaatttttctaaagctttattttttatttctgcattaataatggattctttatcttcaggaattatagaagcttctctgaatgccatcccagctgtaacactgctaagagcattctctagtgcaaatcctgaagtagaaattaccgttaattcattagaatcagaaattaaaggcgcatcagcgggtttatttaattctgctgctgaagcctcaaatttttgaaacatcggtgtttcaaatctagaagattccaatgactgactttgtgcaattgctctacgggaaattttaactttaacgattacagcttggtcagaacgtttatcattttcttgtgcaatagatgctgcaattgcctcatttttggttacttgagctccggtatctttattgatataaacatcaccgaccttcgattcaactttagtaaagagctcggtactaatttccggaactcctggaatgtcttctagtgatacatttttgcgatgtataagaatatatgcatactttttatcataatcccagagttccttaagaaggacgtatctgccacctgaacgactacggataagtctatcagcaataacttgaatttgtcgagcttgaccagcggttttagacttaagaatacgaagcatacaagcatcaattttatactgacgcattgtttgcattgcaacagtaaaaactgaattgatataattaattgggcttggaccaagaccttttaatttagcaattgaacctttagcggttaatgtaaaaggaacaatatgcatcattttatcgcccatttttaaatcgcgattagtatcacctccagatgtataggtacataaacgaaagcctggttgttcaattgcatcatcaacatgaactgaaaaaatttgcggtattttcttctttggatttaagtttgtaatcggaagagtagtatcttcgtcaaataattctgtaataagttccatcatagcctctctagtgtttattctatttataaaattaaaggcccgaaggcctttagtaatctagtggtaagagagtacgatatatttcaaactttggtcctttttcataggcatcaaatgtttctgtaaatttattataagcgtatgcatctacaaattcgagaatgacttgtgatacagaagtagaaacatctccaccttctttttgagcaatgacaattgtttctaagtaagctttcataaaccagttacctcatgaaaatcaccaaatacatcctcgaatgtattagctttagttttatcttcacgtaaacgaatcgcaatcggaagaaataatttaacgtaatcagtgcggccatcagattttaaccaaccgttgcattcgcactctagaatttttccaatataataattttggttttccataatgcgagtacggtcaagttcatgcgattttacaccggctttatcttttaagcctgaaccagcatttaccttaatttttccacactctgattcaagaataaatccacccgctttagtagggtctttacggtgaggataaattcctacaatttttaaatcaacatcaattacttctttaaatttatagagattttttgaacgagcattttcccacaatccatcggtatttttgagaataataccttcaagaccttggtcaatatactttttataaattaccttagcttcatctaggttatttactacctggttttcaattaaaattactttatcataacctgatgtcatttgttctagtttagaaaaacgtacatcatatttcaaacgaaatgcaggaagaccgtatatttctaccaacgggacataatcccagacctgaaacttcatgcattgagcttctttttcagaaatggttccctttaaagatttattggcgatgccattagatgcagtacgtgattcagctacttcggcgaattctttagctttactaatttcaggataagcatcaaaaagaaaatctaggccttctggctccttttcaacttgctcatggtataccaattcgccatcaattaacacaccttctggatgaatctggcgagcttctgcagtcattttgattaactcttccttaagaagatctaatcctagatattcattaccagctcgtgataaaagacgaacatcatctaattcatcacctctgacttcagcaaaacaccgagctccatcagcttttaactgggcaaaggctggaaatttgatattcttattaatgcctttttcatcataagaacttgcaagcatttgaggttgttcaggaattaaacctggccaaactttgtttgcaatagatactgaagcaccgcattcaaggtctcgcatcatcacccgacgcaaaacttcaacatcatcttttttaccgtcagtaatatatccagttaattcctcaattgccgcatttccagtcaatttccgagtagctaacgtgaattcaatgaagtcaagcatatcggtaagagtcaacattccaaaactctgggtagcaatacccggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacataaatgaaaccttgctctacacattttttaaaaattcgttcgtctttttgagctcggaattctggattgcatctaaaaaattgatttacgtgaccgtaatcacgtgtagtattaccttcattttcataaatagtatgaacaacaaacattagaatgctccttggaaaatattatcaccactagtaggtctattatacaaatactctatgccaccaggtttaatatagttccatgtctgaaacggatgtgtctgatatggatgatatagatgattataaggattaaatccaggagttctccaggtagtgttccaaggaaaagaatcgtttttgatcatcttctcaattacatcttttatagctttttcactatcaaaactttctttattttcctttggtgaaaaaagcttattttctacatcattccatgtataaactcgctgtgcagtttttggaatattgtcacgctctcctcgagccatccaataaacaggaacatttaatatttcactcgcgtgatcgcagtggtgagcgagatcgtcaatataacaaattacgttatatttctcttttgcctttttgaacaactcttcttttgaagaatcatgaccacacatcaatacttctgagaaggcaccaggaaaaagagcattcaaattaaattgacgattcagcagagcgtcaatagaatcacccaatgctgtaacagctacaaaattataatcttcttttaatttgttaattacacacagggcatctttatatggagacaagtaacgaataaaatctgaacgattgtatttttcaattaacttgacgccaagttcttcatcacaattaaagagtttaccaggagaaataaatttctcatcttggatcatttttaaaatatgttctaacggaagattatatttctgagcaaaataaggaaggcctgattgccagcttaaacatactccatcaatatcagttaaaatagtaggcttcatagagagtctcttaataggtttaacacatcaataaattcagcttcggttaatattgtatcatcttttgttagaccactagccatgctgtgcttcaaaacttttcctttcgaggcgtgtaatgcatcacgaaagcccttgttttggatcgctgcttcaaaatatgcatttgtgtataattctttccatgctggggagtatcttgaaaacggaactccaagccagaagagggtcccacggtcctgagctctagcataagaccttccagcttgttgggcggcaagcccggataacccaaatatacgacgttgttgttcagcatttttcaccttgcatccttggaggaatccttcaagacctccgaattgaataccatccatgacgaaaggccattgggcgaaattacttaatgcacacgatggccatctaaaattgcttctaatctctaactcagacattttcaatacttataatttcaacatcagcccaatgaccatagcaaggaagacgaaattcaactggccagttagggtccttttctaatataatagacttaacttgtggttcttcatgttcatcagtatatggatttttatctgttactttatatgtgaccttaatgtactgaattccaaaaatcttattaattatattcatactaattcctttaatccgtagataggagataattcatcgcccatacgaaggtcttcatttccatctacccaagaaacaatataagcctcttttatttgaataccactccatttaaacggaggtagaaccttagaaattaatccaggtataccaactccctttaattcaacagtttgacctaaaaagaatttcattaaaacctcatctgaaaaccgtgcgatttaacattaccgccattaatatcagaactattaatttcacgtgcaattgagggatcaatgtcaatttcgcgattgagtttagtgatagctaaagtatcgcgcccatttacagtacggaactctaaagggcagactacattaacgtagtttttaatcgattcactggtaggttgcaaatgtgcaggaaggtctttaggcgcctttgagaaaactacttcgcagaagtttttacgggtatcaaaataagtagtcataaacataacattttcctcagtaaggggccaaagcccctcatttattttaaatatcaaattcgttaagaactacatcaaagattgcttcaagatgctcaggtttagctctgttactcagaatatgacgaatccaagttttaaccaaaagcttgcgattaacgccattccagcaaggatgagtccctaaatcgcgttcacggaaatcatcatccagagcgattttaaagttggaaccttccatcgtgattgaaaccgtgataccgttttcaaatcgcatataaacgtaattaggagtcatatactgctcaatttcgcatactgatccattttgatgtttccaaaggcaaatagtatcaatagaacctgcaataccattagaaacatatttacgttcaaagttgatgtagttcattttattctccaagatgtttaattgcggtacaggtatataatatcatatcctgtaccaaagtaaacaattattttactactttccaatgctgcatgtcaagtttaccaacttttttcatcttctcaattaagcgttcggcacgttggcgagctgtaacataataccattcacctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagttttaactgcagcgttcagattaatcgttttcattttattctcctttgtttgtgtaagataatactatcacaaaggaaccatactgtaaacaactttatgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcgacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggttttttgatatttaacgaccaggataaccataaacccgtcatcataccttatagctcttatctgttgcacaccgttagcttaaaggttccgggttcgatttctcgaggataagatatatactgatggatatataggccttgaggcgtactcccgattggccatcacctcggggtagcatgcacttgccgctataagaataacattcaagaggtacaccgtaaaactgccggggtcttaaaactataatgattcgcaaatcattaatcagacagttcgacggctcctcgttttaacttcacactaaggcagtgaatctccaataaattacttcagtgttaccacaaagtgacgaactgcttttcgtgcagcagaagccagaggcttagcatatttaagttcatctttttcctgaagctcagcagctaatgcagtttgagcaggattcagatgtttgaaataacacaggatttcaagagcttcggcttcaacatcaatagatgcaccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaggtaacgaatttttgtttaatttcttttggctgcttaagacccagagctacaaaagggtgtggaacgtttcgaatttgaccaactggaagagaagtcaaatcaccaacttcacagaaaccttcaggaacatcaggaccgacagagtgaactacacacagttcaggaacttcaccttgaacacgtttaccgataataagtcctgattctgtaacttcttcatcaccggcttgtgcaggttcagaaactaaaataacatattcaccgacagcacgaattggtagctgttgtacttcagacatcgtttttcctttttgttaacagatgaattaataataacaaataattcttaaagcatttatttaccaataaattggagcaaatgctcaactttcataccattaacggaaatcaatttgtcaatagaaaaacctcgccatgcaccaagttcaacatcaaatactggaatcatatcagtagattctttccgagtagattcagtcaatttaccagtttgcatggttggcataaagtcagcatcgcgagtacctttcataacacgaatagtaccatcagacttttcaaaaactacgtttgaaacacccatggacaatttagttttcaaaatttcacgaattgctactttttgttcagtcgtcagtttcatttatttacctattacagttttaatatgagttgttccacgttctttaagagtggaaagtaatttttggcatttttctaaatcagatttccaactatgtggtctatcaatacaaacccagtttgacttataatactgcttccatttagagaaaaaatacttcttatactctacagcaaatgaaatgttctcgttggaataagaactaattgctgtgagctgtaccaaacgaaatttcattattcaccacagaattcgttgatattttcccagtttaacttatttaagtttttcttaggaacattaaacacttcaatacctgcatttcgcagaatatcatcccagccaggtttatttttatcgtatgtttcacaataaaccagctttttaattccagattgagctattgcttttgcacaatctgggcaaggagaaagtgttacatacatagtagcaccttcaattgaagaaccgtttcgtgcagcaaacaaaatcgcatttagttcagcatgaatttcatttttagacgaccattcagagtgcgcgctacgatgttctttcgccaatacaaaacgatcagttgaaccaaacgatacacattcaggcttatgaccttgaatgatagtatgtttaggcttattcagcaaccaaccttgctcagcagcataatcacagcagttcacaccacctgcaggtgaaccattatatccagtagaaataatacgtccattcttttcaattactgctcctactttccaggagcaacattttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcaccagccatctttttgtgaagctcaactggatacttcgtcacaataatagcatcatacacagaaggatgaatactattcactagagtatcgttcattaaagttattctaatgaactgtgctgtttcagagtcaagcgctctatgatcgccagtatcattttcaagacaattatcaattatatcagttaaattcatcatagtacgccatacaccctttgtgcttcaactaatccatcaaaatccaatttgagatgtgttatttggtcaccatcacctggattcacaattactaataccgaacgaggagtttcggtaataacacgaaccgacgtttcaggaaatcgttcagaaaccttatttaccaattcttgagcaaatagtttaactttttcttggaattctttaacagtaattggtttttcgcttagcatgttgatcctagctccttactttcaacatttttaactaatttgacagaaactaattcagcatcttgggtaatcattaccggaccttcttcatgctcttcaagatattctagagctttctttttagcttcttccttcgtatcagtttgagcatagatatagaacatacaaccagtaatacctactactttccacttaatttctttatcagttttaatttcaaatttacttacagaatcatctttttgaacttcttcgaaaaaagaatattctaacatataagcaattgaaaataacgggctaactttataggattcacccattacatcaacagctttataccaacaatcatcaatttcacgtttaatgctaataacatttttcgcaggatctatttttactttaaatgaattttccccaataaactgggcaattcgtttattagccccgcaagtttcattaaaaatatctttatatccagctttaaagcgataaaccttatcttcttcaaaccattcgctcatttcaatttcctcatttgttttggtagagctataatatcacaactctaccgtaaagtaaactattaaattgctttgaattctgatgtctgtgattcaaagcgaatgtcgcctttgataactagctcagcatcaagaccaaatacaacaatgatatgcgcggaacctggatacaacgtaatggcaatagaatccacctggtctggaagcaaagcgttcaatacatgagtcacttgagcgtggattcgaagttcagctgcattatcaagcttttcaaacatgttattagcgataatttggctaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccaactaaaccgctatttacaataacaaagcccaagtttcatggtgccaagccattaaaaatctcccgaagcgacttgccagcattcaacaccgatgcggcgccacatttcaactacttgagttcggtcatcaatagctaatttcacatcaaaatgtggtgcgatgtgtttccagaaaatttcttctttaactacatcatctttacgggtatcgccttgttcgcgttgacactgcatgactaatggaacaccagcaatgtcctcaacccatttacgggtcatacgataatatttcgttggatcttcttcggttccactttcacggcctgaaacgactacgatttgataacccataagagcatacatcttggatagttcaacgaccattggattaataatatcggtatcgcatttttcaaggtcataaggaccacgaccattcatttttgctaacgtgccatcaacatcaaaaataactgcttttggtttaccaggagtccctttatataccggaagaccgagatactctcgcatgcttttatacattgagcgtaaaacatcaattggtactgctttagttccgcgttttgagttgcgtttaaccaattcagtccaaggaacatcaaacactttatgttcaatttgatgcccaagctctttggcaaactcttcccaaaccttacgtcgttcaggattcagattagtatctgaaacaattacacccttcgttgcgtcttggcagagaatcatgttagcaacatcatgctgcatgtaagttacgataccttctttatttttggtatacttgtactcatcgcgttcttcatgtgccataatagattggcgatagtcatcacgattgatattataaaaccctggatttttagcaataaattcgcgagcccaagtactcttaccagaaccaggacagccaatagtcaaaataatctttttcatcatttaattcctaagaaaacttcaagaatacgaatattgtgctcacaccgtcctttgtacaattcagctgttgattgattcgctgatttactctgaacattggatgaaataaattttatcatgtgatttttaagctgatacatatcaagcccacgagctttcgcttcttttcgcagggctttaccagcatcatctaaagctttagcagggtcttcatcatttaatactattccacgatccaaatccatgtatactgcaccatgacatgcatcaatgtaacggtctgagcattcaatataacgttctagcagagttttcatttatttttctcaaccaatgattgaatataatcatgcaggtctttagatgctttgccccacttattttggtattcatttttaagattagcacgtgattgagctaataaaacatcattagttggaggtaaagattctaatcgctgaatctggcgtccataaatcattgcagccatctcggattcataaatcaatcctttgagatgttcaaattgatgccatgaaatcatttacatttatcctcttttaactcttgacgataataacatatcatagttttctggtcgtgtacatatcgttttacatcattaagccaaatacgaaattcctgagaatcttcaaatggcataccgacccaagctttaccatcaataactttaacttgccaagataatttagcttcgtcatatgactttatttgtacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttacgagccaccacatccgccttctttgcatctttgcgcagtttttcattttcacgctcaatagcagcaatcgcctcacgatttttattattcatcgcatcaatataattatactgaattcgcaaattatttaatgctaaggcgttttcattggccgtttttgtaatttctacaacagacgtttctaatctttcaattttattttttaaaattaaagaagttccgcctaatgcaattacaattaatagcaaacctgctgtcgtattacttaattgcataaagttttaataacctctataatatcgtcttgagaaagaccgttaattaaaatatgatgttcagccggagatttagaaattttaaagcacgccgcaacatcttctgccatatccgatgcgctacgatttggattactaattccaagacgatgttttcccgttaaaggattaacgatgatatagcatttacagttgttaatatgaacattaggttgagtctgattaatgaacacatcgcaatcatatttcgcaagctgattttctaaaaagactttcatctcctcaaccgcatcaggaagcatatcacgggcttgctcaagacgacgatttcgatattctttaatggtcgttttccgcttgacttgcttagctaaatctttcttaagatcggtgatatatccaactcgacggtttcctttaaatacagaaatcccatctgtagtatcaccgtatgcttcaacgaccatttcagtagtaatgagctgcaaatccatcataaagtcctcatgttatgtcagtaagattactataacacaacacgagggacttgtaaacagcttagtatccttctgggataaattttttataatttttcaaaaaattctgttcgatttcgcacatgaccttttcttgactatcgtacccctgatataggctcataatgataccgaacaggtgatccattccagcacctttagcaacgccttgcgcttccatcgcataagtctttctatctttaccgcaatgcttattgtgacagtcaagaactaaaaacagagctcggtctaagtacttcagataagtcgtctcaaatgcttcaatttttctatatgaatattcatcgtcagcgtacattgctttaagatcatctgatgcaccatcaataatagtcttaaacaatttttctggattatctaatgaactttttgtactatgaagagacacgtaccaatcagacttaattttaaaatgagaaccatctttcatcacggcaacatagccttcgatgttttctgcatttttagcttcttctacccatttagggctatcgatttcgaatcgttcaactagatatggacgaagagcagcatctttataaatatcatcgtatgaaatgtattcacccgtttcgttttcacgaacattcagtaaaataattttcatttcttggtaagcaagaacgattctattcgtcggagcaacgaattcgaagttagcagtaaatccatcttcagctaattctttaagtctatcgcgcaaccgatggtgattaatattcatcaaaatcccattagccattaaagcctgctcagatttgattgaaccctttgatttgaacagaatttcatcaccatctaaataagttgataccaaagacccgtcttcttttgttagaatgtaatcaacatcatttaaatcgatattcatcgtgaatggattttcattcaagttaaaaaacttttccataggacgagaagcgattcttaccggtttttctccatccatttcaaacataattccacgacattctaatgcgtctggaagtaaccaatcagaataagatgcataattatatgagaaaattctgtaagttcttccagacgcacttacatcatccgagtaaaaaaacttacgctgtgaatccttacatagttccattaaattgttaaaaagttcttgcattgtgtatcctcttttgtgttttgaatatagtaccacactccatgtggaagcatcattttttcttgtgttgaatattccaaggcgggttaaacagtttaatgaatagcggctcctctaggtcaatcgttgcgattgtcattgtacctaactcatttgtcatagaaagattaaaacattggcgggcgtaaaattcaactttgcttccttcctttagcgcagaatgaattaatgcagatttagtagaatcagacgttttgtctttacgattaatagcagttctataatagtttattcttttacgtaaatttttagtttttccaatataaacaagctcatcatttatagcaatagcataaattacgttatacttgtttggaatagataattgttttatacttccgttgtcgtctaattctagctcagtatatttaataaatgaatattctgttgcaatttctttcataataaaatgggccttgcggcccactccttaaaagtattttttaaaactcatcataactttatcatcaacatcattatcaatctgtgcaacaagataagatgacagttctacttcttgtggcgctgattgaacattatcagaattaagatattcacgaatccaaggatatggatgtttaaccggagcatcggtaattgggcatggaagaccacactgtttcatacgagatacagttaagtaatcaataaagctccacatgctatttgtatttaatccaggaacatcgccatctttaaataaatgaactgcccaatctttttcttggcggttaacttccatgaaaatatcaactgcttcttgctcgcactcttgagcaattttaacccattcatcgccatcagtaccagattgaagttgacgaataatatattgtgtacctttaagatgaagctgctcatcacgtgcaatgaacttcataatcttggcattaccttccatgatttccatgtttttatggaagttaaaggtacacgcaaaggatacataaaaacgaatagcttctaatgcattgattacatgcaaacagaggtaaagagatttcattagctcacgcttccaatatgtctcatgctcaatagcatcttcaataacgtcttcgtctgcattaatttctttttggtattcgatatcagctttagcgttttcccaataacgagttttaatcagaacatcatcataataacgtccaatggattcagcacgtttcataatagcttcatctaatacaatttcatcaaataccttcgatggatcagtataaagatttcgcatgatatgtgtatatgaacgactgtgaatagtttcactaaaagtccatgtagcaacccatgtatcaagacttgggtctgaaattaacgacataagtacagcagatggtgcacgaccctgaatgctatccaaaagtgattgatacttcaagttgttagtaaaaatatcttgctgatattgaggaagcttgttaaattgcgcagcatccatcattaagtttacttcttcaggacgccagaaaaatgacaactgcttttcggttaaatcttcaaaaactttatgacgttgaatatcataacgcgcaataccaagacctgaaccaaaaaacataggttcttttaaaacatcaactggatttgtattaaaaactgtgctcataaattttccgcttagttaatagttggtgactcgtccgtgagtcaaattatatcataatttacaggatgaacaatcttcagcttttggagtttctatttcataatcatcagtaccagaaccatcacgggtattatgataatagaaatttttaatgccataataccatccgtatagcatgtcatcaatcattattgacattggaacctttccttttggaaaaatctgcgggtcatagtatgtattcgctgaagctgattgacatacccatttcagcataatagctacctgcgtaagataaggtttattacctttcttagctaatttccacgtataatcatataggtctatgttatgctcaatattgggcacgacttgattaaaggagccctcttttgattctttaacagagactggtccacgtggaggctcgataccgtttgtactgttagaaacttgggaagatgactcacatggcataagtgctgataatgtgctattacggatgccaaagagcttaaggtcttcccgcagcgccgaccagtcacaaacgtattttggagctgcgatttggtcaatctttttattgtaccagtcgataggtaattcgcctcgagaccaacgagtgtctgaataatattcgcaaggtcctttttctttggcgagcttaatggatgctttaatgagcccatactgtaatctctcaaatagttcatgtgttaaatcgttagcatcttcataagaagcaaagttacttgccagccaagctgcatagttggtaacacctacaccgaggttacgacgctttttagctttttctgcttcaggaactggatatccttggtaatccaacagattatcaagagcacgaacttgaacttctgccaattcattaattttatcttggtcttgccagtcaaaattatctagtacgaatgcagagagagtacacaatccaatttcagcatcaggactattcacatcatttgttggaatagcaatttcacagcacaagttactctgacgaataggtgccttttcacgaataaacggagtatagttattcgtattatcaatgaactgtacataaattcttgctgttcctgagcgttcagtcatgagcaattcaaatagttcacgggctttaatacgctttttacgaatattagggtctttttctgctgcttcgtataattcacggaaacggtcttggtctttaaaataagaataataaagctctccgcccatttcatggggactgaacaaagtaatgtaatcgttctttccaaaacgttccatcatcaaatcattcagttgaacaccataatccatatgacgaatgcggttttcttctacgcctttgttatttttcaaaacaagaagattttcaacttccaaatgccaaataggataataagcagtagcagcgccgccacgaattccaccctgtgagcatgatttaacagcagtctgaaaatgtttccaaaaaggaataacaccagtatggcgtacttcacccatgccaatcttagaaccttcagcacgaatcataccaacgttaataccaattccagcgcgtttagagatatattcaacaattgaagcagaagccttattgatagacttcagtgaatcgcctgcctcaataacaacgcatgaactaaactgccgagttggagtacggcaaccagccataataggagttggtaatgaaatctgtcgagtagataccgcttcataaaaacggataacatgttttaatctatcaacaggttcatcttgatgcaatgccattccaatagtcataaatgcaaactgtggagtttcataaatttgaccagtggttttatctttaactagatatttttcttttaattgcatcgccccggaataagtaaattccatatcccgctcgtgcttaatttttgattctaaaaatgtaatttcttctgctgaatattttgacaacagttcagggtcgtatttaccttcatttacacagtaagaaatatggtcaataaatgaacgcggttcatactgcccataaacatgcttacgaagagcgaacattagacaacgtgcagctacatattgataatcaggctcttcaaccgaaatagaattcgcagcggccttaatgacaatagtctgaatatcatcagttgtcattccatcacggagatatgatttaatattttcatataattcataaggatctactgatgttccctcagatgcccaagataaaactttaataattttttgcgggtcaaagctctgagaaacaccactacttttgataacattaattaattgcataagtcctcaacttgaaaatcgtctttaaacagtcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccgacatagacggcccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctaactcacttgggttaggaagtgtaaaaagaactacaccagaagtatctttaaatcgtaaaatcataaatcctcacaattaaattaaaattacaccgccatttttcctttcaagacgccgtgggactgataatctttgagaacgaaatctttaggcctgagtttaagaatgtattccaattgttctttagtagaaagatagcggaatttataaggcaatccgcctattaccagttcacaaagctctttaggttcacgacgcaaaatttctttacattgttctacgtgattcatatagatatgagtattaccaccggaaaatatcaaatctcccggaataagattacacatcttagctacaatatgaactaacgtagcatatgatgcaatattaaatggaagcattatgttcagataaggtcgttaatcttaccccggaattatatccagctgcatgtcaccatgcagatcagactatatctccaacttgttaaagcaagttgtctatcgtttcgagtcacttgaccctactccccaaagggatagtcgttaggcatttatgtagaaccaattccatttatcagattttacacgataagtaactaatccagacgaaattttaaaatgtctagctgcatctgctgcacaatcaaaaataaccccatcacatgaaatctttttaatattactaggctttttacctttcatcttttctgatattttagatttagttatgtctgaatgcttatgattaaagaatgaattattttcacctgaacgatttctgcatttactacaagtataaacagaagtttgtatgcgaacaccgcacttacaaaacttatgggtttctggattccaacgcccgtttttacttccgggtttactgtaaagagctttccgaccatcaggtccaagtttaagcatcttagctttaacagtttcagaacgtttcttaataatttcttcttttaatggatgcgtagaacatgtatcaccaaacgttgcatcagcaatattgtatccattaattttagaattaagctctttaatccaaaaattttctcgttcaataatcaaatctttctcatatggaatttcttccaaaatagaacattcaaacacattaccatgtttgttaaaagacctctgaagctttatagaagaatggcatcctttttctaaatctttaaaatgcctcttccatctcttttcaaaatctttagcacttcctacatatactttattgtttaaagtatttttaatctgataaattccgcttttcataaatacctctttaaatatagaagtatttattaaagggcagtcctacaatttagcacgggattgtctactagagaggttccccgtttagatagattacaagtataagtcaccttatactcaggcctcaattaacccaagaaaacatctactgatcgttgataccactgcaaatccaaatagccattacgcacattaaactgatagaacatatgacaaggcggtaatgccatctgcttgagttcagctggattccatgctgaaacaatttgacgcctatcatttggcaattttttaatacgatcaataacttctataatttggtctacaccaccaaaatcacgccactgttttccataaattggaccaagttcaccgctatggtatcctaaatcttttgcttgattttcgtaattttcatcccaaactgttttgccttggattaacgaatcatgttgaattaatcgcaaatcattgacatttgtgcttcccgataaaaaccaaagcagctcagcaatgcaagctttccaggcgagcttcttagttgttactgcaggaaaacctttagttaaatcccagcgtaatttagtaccgaacaaagcaattgttcctgtgcctgttcggtcatcggtttcgtagccattttccaggatatctttaattaaaaattggtattgtttcattagttcatccaagaatatgtagaaggatatttggcaaaattaggcttatatcctaatttaaccatttgttttgctttgcgagtaaatcctaaagaacgctcacctttaagatattgttttggtgtcataggcccttgatgcatctgccgacaaataaaaagggccatagcattaggaacatccttaacttttaatttattgctcatttatatactgattccgtaagggttgttacttcatctattttataccaatgcgtttcaaccatttcacgcttgcttatatcatcaagaaaacttgcatctaattgaaccgttgaattaacacgatgccttttaacgatgcgagaaacaactacttcatccgcataaggtaacgcagcatataacagagcaggcccgccaattacgcttactttagaattctgatcaagcatagtctcgaatggcgcgttatgacttgaaacttgaatttcaccaccagaaatgtaagttatatactgttcccaagtaatatagaaatgtgctaaatcgccgtctttagttacaggataatcacgcgcaaggtcacacaccacaatatggctacgtccaggaagtaatgtagataatgactggaacgttttagcacccataatcataattgtaccttcggtacgagttttaaaattctggaggtcctttttaactcgtccccatggtaaaccatcacctaaaccgaatgctaattcattaaagccttcgacggttttagttggagaataagcgaataccaatttaatcattacgcaaagcccctttcaataaaccattcagtggctttattagcgtcaaagaataattcttcatatgtcttttctttgttttcaaagactgtcacacaaacacgttgacattctccacagtattcttctgacatactcaaagcgtcagaaaacatttcattaaattcatttaaatcaggattatgcaatgcgttaaaaattgcataatcgaattcatcattcataaattcaaatacaaaaatcatattattttccttaaacagactttttcacaattttccaatcagctttaaactgctcgacgtcagaatggtaaatccagaatcctgcgctttcaccgtcttcataaagcggacacccatcacattcatcttcccatcccatgccacgtaaaaggtgttcagctttttcaacaagttcagaatctttaccgatgatattaaaataccatttacctctaacttctgaatctttgatgctctggcgttgtaatctcattttattctccttagcaagctttaatcaaaagatataaacagaccaacataactgctgccataatataaggtgcgaacattttcttttctccattagttttgatagggtaatagtatcacactactacccttctgtaaactactttttgaaagtttttcgcaaaagttcaatgatttcatctacattgttttcgtcaacaatgcagtgaatttttgttacgccagaaactttgtctttgacttcatcttcttcagaagtcggttctttatactcacgaaaacaatgaaattcgtcttcacaaacgttaaagtaaaaatgctttccatttgcgcattcaatgtgttttattactctaaatccatcaacaaagaaagcttctttaacttcaaaccatccgccattttcttgaataattttaactattgctgaattagaacgtgggcgataattaataaatgtatcaataagtcttggaacaagttcatactttttaccgatatacattatgttttcctcattttaacggggctgtaatagccccttgataattattgttcaatcaatcccatgtaaaattctgcgtcttcagaatccataccatcacaatattcattagccataaagcgggtgaggtcttcaagaggaccttcaataacgatttgaatactccaaaacttagaatcttgcacgcttgtgatactaagttcaggataacgattacgaataatttcttcgatatattcaaaatcaacgatgtcaatatcaactttagccatattattttcctctttaatcatcagcagtattgccgatagttgtatagtaccatggaaggacaaggatgtaaaccgttttgtgaaaaaatttttgaaataaaaaggggacctctagggtccccaattaattagtaatataatctattaaaggtcattcaaaaggtcatctaggtccgtgtcatcagcactagatgaactgccagagcttgagctcataaaatcatcttcagtttttgtattgaagtcatcaacattgaatgcatccaaatcatcagcaactttatcagctttcttagcagcagttgcagcagcaccgcccatcacagcagttcccataacttgaccgaatttagtgctcagttcttcaaacgatttgaatttatctttagaagtcatttcagaaaggtcaaccatttgttcgaacagttctttctggaaagattcatcgtcaatatttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttacaacaagaatattagcccagtaagaagttttacgtttaacaagactgtactctttattgtcagtgttgtacagatcatttttactgatgtactgacatactgggcaagaatcgtaatcaccatgggtagatgaacatgtttcaatataccatttaccatttttcttgaaaccgtgatttacaagaattgcgaatggtgcttgttcatcatttttagacggaagaaaacgaattactgcttgaccgttacccgcattatcgagtttcagtttccactcgcctttatcttcagaagaaaaacctttattgccattcagtttagccatttgtgcagcaagttcagcagtagatttacgtttaaacattttatttcctttttaatttaatttaatttaattaacagttggtgctatgacactttacctcatagctggcataattcgcaatactctgggtcttcgagaggtatccaacctgagttgaaatactttaccatcgatttagcagttgtatcagttatatttatattacctttaactcttcgccatccaggagttttaccgtacagattagaggataataataacacataattctcgtaagcaatatgagataatttccaagactctatattagctcgtgatgttttccaaggtctaaaatcgtcacggttcatataattagccaatctcatatgctctctaacttccgggtctttggctggatgagtttcaccactcacaccaaatccaccaccagcatataccagattaaaatagtctggattatctctggcatttacttcaagttggtattttcgttctgcttcaataacatccaagtcatcatcaatttgaattattttaacgctcggtttttgaagcattagcgcattcaaaaatcttttttgtttacatgagctccagtattcctttccggaagagtcatatattattccgttctcaaatgagcaatttaatttactaccgatataatagtatggcggagtcttatttttgacacggtcttcaaatgtaaaccaatatactatattcatatcaatacttgcaagatttcacagtttcaatgaaaacacttttagctttctgtgaatcaatatttaaaatttttctataagcctttaactttatagaataattattccagactaaattatcagtctgttcatcatgtttatcaattatatttaaaaacgaatcaagcaagataaacgtttcaaacgaaattatattcgattgaagtagtttaaaaatataacttgattgaacttttggattatactcaaagatttctttaaaagcagaaacttcaactttcttactaaaataataaatgttgcgaatatcttcttcaaacttaaatttaatttgctttaagcgtccgatatattcacgataaaacacaagtgcatcagcgtcagagatgtcgccaatccaagcatcctggttagcaacaagattgcttataaagattaaagcaagttcctttaatttatatttttctgataacttctggaaaaaatacttatcccttcgcttttgataagcggcatcagacacccgcatgcaccaattatacttaataacatcatactttccattcatatgttgttttatcattaagtataatttataaactgatttaccatcaatgtatctttcaccaccagcaggcatgcggagtttaatcatagtagaaaatctaatgtattagttttttcacaacgaacaacagaaggacgtaaaagattttcgtcaatggcttctgactgaattttttcaattatacccgaaggaataaatttagcaaattgagtttcaggaatagagttttcttctaagaatgctgttgtagcttcaagataactcattccaaactcttctaccattttttcaataataaatccattttcttgacgatcaagaagctttgctatttcatccttttctttcttgattgaaagttctttttctgaaagaccggtctcatcgaccggacgaatgtcatttagagaaaactgtgtcataaagttcaactacctcttcagtttcagcttcaaacacatcacggttatctttatgatacaaagctaatagacgattaaacatcttaccatcaacgccaagttcatctttggcacgaattcgaatatctttaatcaattcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatactcagattctgagagaagcaccttagcttgctcacggtcattagcaatagcttcaacgattgaagttttcattgaaggagttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttatgcatcggtgaccattgcttaacatttggatatttgtgaagctgtgtaaagtcaccatccgacgaaatgattaaaatcttgtgtccttctaaagagaactttttaacaagaacagcaatatggtcatctgcttcatacttatcaatatccataacaatgtatggcatataagctttcaattcatctataactttatggctggattcaaaataaccttcccagtcccaagtagattcttctcgtgcttttccacggtttttcttgtaatagtaagcaaaatcacgacgccagtatccagatttcgcgttatcaatacacagcacaattttagtgtatccaagcgtttttgcttttttgacattaaacttaattgagttcaatatcaaatgacgaaccattgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgatcgtaccgtaggaactgacggtgttaacgttgattacttaattcaagaaaacacagttcagcaatatgacccaactcgtggatatttaaaagattttgtaatcatttataataatcgtttttgggcagcaacggataatattccaaaacctgctggaaattttaatagaattcgttggaaagcattacgtactgatgccgtatatacaaccgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatgatattcatttttaataatcgtttgtggcaaatgtatgttgctgattatagcagagaagctgcgattgttactccatcgactgcgtatcaagcacaatctaatgattttatcgtacgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaaggccgtacatcgattgacggtttcttgatgtttgacgataatgagaaattgtggagattgtttgacggggatagtaaagcacgtttacgcattataacaactaattcaaatattcgtccaaatgaagaagtcatggtatttggcgcgaataatggaacaacccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaatggtgaaactaattatgtaccagttttgcaacttgcttatatagaagattctgatggaaaatactgggttgtacagcaaaacgttccaacagttgaaagagtcgattctttaaataattctactagagcaagattaggcgtaattgctttagctacacaagctcaagcaaatgctgatttagaaaattctccacaaaaagaattagcaattactccagaaacgttagctaatcgtactgctactgaaactcgcagaggtattgcaagaatagcaactactgctcaagtaaatcagaacactacattctcttttgcagatgaccttatcatcactcctaaaaagctgaatgaaagaactgctacagaaactcgcagaggtgttgctgaaattgctacgcagcaggaaactaatacaggtatcgatgatactacaatcatcactcctaaaaagcttcaagctcgtcaaggttctgaatcattatctggtattgtaacttttgtatctaccgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacgccagaaacgttacataaaaagacatcaactgatgcaagaattggtttaattgaaattgctacacaaagtgaagttaatacaggaactgattatactcgtgcagtcactcctaaaactttaaatgaccgtagagcaactgaaagtttaagtggtatagctgaaattgctacacaggttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttaataactcctaaaaagcttttaggtactaaatctaccgaatcgcaagaaggtgttattaaagttgcaactcagtctgaaactgtgactggaacgtcagcaaatactgctgtatctccaaaaaatttaaaatggattgtgcagagtgaaccaacttgggcagcaactactctgataagagggtttgttaaaacttcttctggttcattaacgtttgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgagtgcccctcttgtatcatctagtactgctacattcggtggatcagtttcagcaaatagtacattaactatttctaatactggaacggcaactcgtctgatttttgagaaaggacctcaaactggaacaaacccagctcaaacgatgacagtcagagtgtggggaaatcagtttagtggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattagcggaaattatggtttcattgttcgcaatgacgggtcagtaacgaattttatgcttactgcatcgggtgatcaaactggcggatttaatggattgcgtcctttagctattaataatgcatctggccaagtaacgattggtgaaagcttaatcattgcaaaaggtgctactataagttcgggtggtttgactgttaactcgagaattcgttctcagggtactaaaacctctgatttatatacccgtgcgccaacatctgatacagtaggattctggtcaatcgatattaatgattcagccacttataaccagttcccgggttattttaaaatggttgaaaaaactaatgaagtgactggacttccatacttagaacgtggtgaagaagttaaatctcctggtacattgactcagtttggtaacacacttgattcactttaccaagattggattacttatccaacgaccccagaagcacgtaccactcgctggacacgtacatggcagaaaaccaaaaactcttggtcaagttttgttcaggtatttgacggaggtaaccctcctcaaccttcagatataggagcgatcccatctgataatggaataataggtaatcttactattcgcgatttcttgcgaattggtaatgttcgcattattcctgacccagtgaataaaactgttaaatttgaatgggttgaataagaggtattatggaaaaatttatggcagagtttggacaaggatatgtccaaacgccatttttatcggaaagcaattcagtaagatataaaataagcatagcgggttcttgcccgctttctaccgcaggaccgtatgttaaatttcaggataatcccgttggaaatcaaacatttagtgcaggtcttcatttaagagtttttgacccttctacgggagcattagttgatagtaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtgtcatatgctgctttttatacttcttctaaaagagctattgcattagagcatgttaaactaagtaatagaaaaagcacagatgattatcaaactattttagatgttgtatttgatagtttagaagacgtcggagcgacaggatttccaaaaagaacttatgaaagtgtagagcaattcatgtcagcagttggtggaactaataacgaaattgcgcgattgccaacttcagctgctataagtaaactttctgactataatttaattcctggtgatgttctttatcttaaagcacagttatatgctgatgctgatttacttgatcttggaactacaaacatatccattcgtttttatgatgcatcaaatggatatatttcctcgacccaagctgagtttactgggcaagctgggtcttgggaattaaaagaagactatgtagttgttccagaaaacgccgtaggatttacgatatatgcacaaagaactgctcaagcaggtcaaggcggcatgagaaatttaagtttttctgaagtatcaagaaatggcggcatttcaaaacctgccgaatttggcgtcaacggtattcgcgttaattatgtctgtgaatcggcttcacctccagatataatggtacttcctacacaagcctcttctaaaactggcaaagtgtttggacaggaatttagagaagtttaaactgagggagccttcgggttccctttttctttataaataatattaaaataaaggggcatataatggctgatttaaaagtaggttcaactgtaggtggatctgtcatttggcatcaaggaaattttccattgaattcagccggtgacgatgtactctacaaatcatttaaaatatattcagaatataataaaccgcaggcagctgataacgatttcgtttctaaagctaatggtggtacttacaccggtccaattactattaattacggggtaaatagttatcttcaattaagtaataatgaaacccccatccgaattcgttctggtggcggcactggtaatactcttgtagttggtggctcttctggcggtattagttttagaccagcaggtagtgaaatcactactggacaaattactattacgccagaaggtttgacaacatttaccagggctgtaacggctccatctgtaactgttacatctactccttccgcagcatctgatgttactcgcaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagtaaaactgcaggtcaacgtcctgctgcttcagtattagccgaaggtgaattggctataaacttaaaagataaaacaattttcacaaaagatgactcaggtagtgttatagaattaggtttaaaatatggaggaacaattgatggttctttaactgttaatggaaacataattggaaatttaacaggtaacgctgcaactgcaacgaaattaaaaacagcacgaaaaattaatggtatatcctttgatgggtcaaaagatatcacgctaactccatctgacataaatgtcaatagcacaacgtttataaaaaataacggcgaattacctgttgatgctaatttagatgagtatgggcctgttgaagaatatcttggagtttggtcgaaagcaacttcaaccaacgctcaaccagcaaataaatttccagaagaaaatgctgtaggtgttctagaagtatttgtggccggtcaatttgctggtactcagagatatacaactagatacggaaatgtttatattcgttccttgactgctacatggaacggagtaaacggtccgtggagtgcgtggcgaaatattcaatctggtactcgtccactgtcaacaacgattgatcttaatgatctaggaggcgctgaacactttggtttgtggcgaaatagttcaaattctattgctacctttgacagaaatttcccagaagaggggtcgtcagctcaaggacttttagaagtatatgaaggtggaaactattctcgcacacagagatatacgaccagatttggtgttgtttatactcgctgtcttgctgctgcatgggatgcatctgcgcctaattggggaccgtggcaacaagtcggtaatgtcacaccagcgactttctatgacggagatctgaatgattttaaaacccctgggttatataatattttaggcactgatgccgttattaactgtcctacaggtgaaggtttgccgactgttattgttggtttgctggaagttaaacaacgtgcttctggcggtgctattttccaaaaatttactactgccggaacgggtgcaactactcgcgatcgtatttttgagcgtgcatatactggtggtgtgtggggtgcatggaacgaagtatatacatcttactctctgccaattactttaggtatgggtggtattaaaactcaattagcggagctagattggcaaacctttgattttgtccctggtagtatgtttagtgttcctttgaacaaaataaagaatatgccagcaaatatggattggggcacgattgatggaaacctggttatgttttctgtcggtcctagcgaacataccggaacgggtcgaactgttcaagtgtggcgcggtactgtatctcaggcgaactatcgttatttcgttgttcgtatcgctggtaatccaggaagtaggactaatacttgtcgtcgtgttgttcttgaagacggatcacatacttggactgctcaacaaaactttaggggattgctgaatatcactgctgctgttaatcttggtgctaatcagaaaatttcacttgctccaggagcatatattcaagcccctgctagcggttctggttctaatacttacgcaaatcagaatactaccattgcgccattatatcaggctattgacgattcaaataaaaaccagtttgcgccaattgttaaacagaaaaacactgtaacaaatattactatggcttctggtatggatattgctagttcagaatatcgtatcgttgctcagggtgatttatccgctactggaactacagccactgaattagctacatggcgtttcttgccgtctggccgattcatgtcacaaagccgagtttatgctggcgcagcattcttgaacactgatggtaacattgctggttcaatctggaagaaatacaacaatgcaaccaatttagatgctgccttgaatactcgcctaggtaaaggcggtgatacgatgacaggtcggttaacaatcaatgcacctaatgattctattgtattatcaacaactgctagtaattctttgcatattcgcggtgacatagacgggactggtaactggtatattggcaagggtggtgctgataattcgctggcattttatagctatgcttctcaggcggcagtacatatcacaaacaatggtgagattgcgttaaacccgcaaaataccgcaatggttaacgttaaccgtgaccgtgtacacattaacggttctggatggattgctagacaaccgggtgattggggcaaccaatggcgagtagaagctccattattcgttgatcatggttatgtttcacaggattgttattatcctattcttaaagcaagaagcgttataaccaatcaaggatatagcaccgctgttgactttggtatgcgtcgtattccatcacagtgggggcaagcaatcattcgtgtcggatccacggaggcttctcctgatgctggacacccacaagctgtgtttgaattccatcatgatggattcttttatacaccaggaaatggtagctttagcgatgtgtatattcgttctgactcccgtctcaagattaataaagaagaattagaatatggagcggtcgaaaaagtttgccgactgaaagtttatatttacgataaagttaagtctattaaagaccgtagtgttattaaacgtgaagttggtattattgctcaggaccttgaaaaggaattaccggaagctgtatctaaagttgaagttgatggatctgatgttctgacaatttctaactctgctgtgaatgctcttttaattaaggctattcaggaaatgagtgaagaaattaaagaattgaaaacgcctctctttactaaaattgctcgcaaaattagtaaatattttaaattctaacaacaagggggaaatgccccctttggagtataaattatggcagtagttggtgttcctggttggattggaagttcagccgcaaatgaaacaggacagcgctggatgagtcaagcggctggtcaattaagattgggtgttccttgctggatgagtcaatttgcaggtcgcttcacgagaaattattcacacgcttggagcagaccataacttcaatggtcaatggttccgagatagatgttttgaggcaggtagtgcacctatagtgtttaatattacaggtgatttagtatcatattctaaagatgttcctttattcttcatgtacggagatacaccaaatgaatatgttcagttaaatatacatggcgtaacgatgtatggtcgtggaggtaatggtggtagcaatagtcctggctcagctgggggtcattgtattcaaaacgatattggtgggagactaagaattaataatggcggagctattgcaggcggcggcggtggcggtggcggcggatattattctcctttttcacaaatgagattaacctttggcggtggtggtgggcgtccgtttggtgcacctggcggatctattgatatgcaatcaggcgcaactgctggtactatttctgcacctggctcaggatccgtgaatggtatctataatggtggaaacggtggtgaagtaggttccgcgggaggtagatgcaatattcgcggtcaaggatctgaatataatggcggcgctgctggttatgctgtcatagggtctgctccaacgtggcaaaatgttggagcaatatatggtccaagagtataatgtgaataaatacccttaaaaggagggtctatggcagcacctagaatatcattttcgccctctgatattctgtttggtgttctagatcgcttgttcaaagataacgctaccgggaaggttcttgcttcccgagtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacgataaccatgtactggtatagaaatgatcatataagtaatgaccgccttgaatcaatatgtgctcaggcggccagaatattaggaagggctaaataattatttgttcgtatacatttctagatatcgatatacaccctcaaaaccctcgttgaattcatcgatgagggttttcttatcttcttgagttaattcagaaacaattttacgaaatgaattctgatttaactttctaccttcatgcgttactccaatctcattaagaaatgcaataaaattagcacgattctcaacaatatcttctctggaaaatttaatcaaaatagacgcaacagtaataatttcacgaactgtatcaatatttttattcattaactataccactcaattagttgactttgttataatatcatcagacgcttgatttgtaaactggtctgtgttattttcttcaaaaattttttctacgaattccttgaacgactcgcgttcctgagctacattatgctcgattaccttttcaagattatgactcattcgaaataatcttcaatttcgtaatcatggacataaatcattatagtttttaatacatcatcaatactttttcctggagctggaattacgtaaaaatatcctgcttttgagaggtctttataagttccaatcaagaaatcattattctcaagatgtaactcttcaactaattcattgacaattgaatggtataggtttggtagaaacttatatagcttttctagaatatcaattttgattgtgtattgaaccacggactgagaatcaataatcatagaccttccccttatgtttctgtttgcgattagattctttaaacgctttcttcttatccttatgaacagaagctttattaaaattatgctttgcgactaaattgttcatagtgctgaattacctctcttaaacatttgcatgtgaatgaaaactttttagctacaccacattcaaatatatgttctcttaaatcgcgtgtatcggtatatcccatctcaacaataaaatgccgtattagatttttatctttatcgttgagagaattaaaataatcggattttgaattaatttccctggccaatttgaatcaccttcagttggcgttttagctcttttatcatctcttcgttcatcgcaatataaagatcgcgtaaagcaagttttagcattccatttactggataactaaatggacatacataatcttttcctacgagctttttagtgaattccatatcacagaactgaaatgccggttcatttgtataaattccccaattagttgacatcattttattggcatattccagcgcctgaatttgattcataattccatcaatttgaaactttttaatattcattagtaaaggtcctcagagtaaagttctttttcactaccaccacgttcaatacgtacttgtccagcataagttgcaataatcattgcttcttcacgcgtccaataattactatattggtcaataaacccttggtcatcatcacaaacttgctgagtaactaattggggtttaactacatctaaaactgctgccatatctttagaataatgacgagcacctggaataacaagagttcgtccatcttttaatttaaaacggttggctgcgcaaacaattcttcgttgatacttttgattttcatcccaatatgcagtctgccaacagatttcaggaacttcatctaaaacattttgttttgtatattcaccgccgtaagaagctaatttagcagccagactttctggagtctcacgtgacaaagctttatctaacagagctaaacgttctttaaaagttttcatttaaaccatcctttaatacgttgccacaaagttttctgttgagctttgttaacgccaattgagcgaataactggttgagattcctgaaattctttataatcagcaaggtaaatttcgtaagctgcatccataaaggaacttatcgctgccataaaattattgcgaatacctactggagcatctttactttcacgaataatcatgtatttaccagtcttaatctttacaatagttccaagataagccccatggtaccagatgtcccacccctcttgagtgggttctgcacaacgacgaagttcattaacaatttctaacttgttcattatttattcctcacagttcagatgctacggtgattacagcttcaatgttttctgccgagcgtttaatgtcaagatacacattaccatttttagcgattttacatgacattccgatatcagtaaatttctgaatatgatgttccatcattttgtatccaaaaattcgcatatttccattgttgttaatttcaaaattgcgaattccgtgagtgcgtttttctaaaatagcgagatagttactacgataagtttcaacctttttaagaacaaatccattttcatctaaaagttttaacatgaagtctttatcttcttccatatcagaagtaatctcgcgagctttacgagttgctcgttttttcagcagttcaggagcattttcctgtgcatataaagttgccgcatttgaaataatatcctgagcttcaccagtaatgattaatccatcaccagatttctccaccaggccttttttaatcaataccccaatattactattaactactgcgttacctaaatctggatgcacctcacgaacttctgcggctgtaatgaaatctttcttagcaatagtaattaaaatcgcagcagttttttcattcagaacatcgttagaagctttgatgatgtaagttactttagacattttctaatctccgtaattctgtatcagtagttgatagttgtatagtaccacagtatgctttggttgtaaacctttttgtgaaaaaaatttttgaaataaaaaagggagagcctcggctctccctaaaattactgcatgactgtgataactgtcatgataacacgttgaatgccgaacgcaagaagacctcctgctacggctggaacaacgcctagaccagctagcaaaacacctccagatactagcgctgcgcttgtaatacctatgaatggactcatttgatttcctctaaatctttagtgtattcagtaactacatcagtagttttccaatattcgttttcttcttttttggctttagcttcttcagcaagtttctttgcttcatcggaagtcatatgaaaaatattcattccaactagtttatcaacataagaagaatacatatcaattttagaaagttcttcggtcagttctttacgagttttaccctgcacaacgatttcacctgaaattactttcttaatgaaatgtgccttggcaaaagctaaacgaaaagctgactcagtttctttaattttattatcaattcgtttttggacataagttttacgaacttcaacaaagtctttaattaaatcgactacgttatcgtaaacttgtagttttcctttttcattaataaccgtaatattctgagaccgacgctcaatcaacccgaagtctttcataatttttgcatggcgttcttcttcgttatcactcaaagagtattctttgcggaatttaactttaaagccaaaaccatgctcaccgcaagcatcatcccatgtaatgaagcctttatcttcaagtgggtctaagattttactcacataagtttcacgatcatacttatacggaatctcagtgatatgcatttgagttcgtgaagtaaacttatatgttccacgaatttcatattgcccatcaatttcaacgacttcgccacgaaattctgggaattctaccttcggtttagttactttctttccttgaagagcttgcagtacagctttcttgacagaagaaacactatgaggaagaatgtaagttgcataaccagttgcaataccggaaacaccattaagaagaacagtaggaataataggcaaatagaaagcaggcggaatgtgttctttatcttgatgtaccggagcatattcagtatctttatatacgttatagaaatttttacttacacgagcaaaaatataacgactagctgctgccttttggacagtacgagaaccgaagtttccttgaccatctaacaaaggaaagttattattccaagtgttagccatcaaagcccccgcatcttgtgcagagttttcaccatggtgatatccaaggtccgctacaccacctgcaatagaagcgagtttgtgaaacttatctttatttcctcgtgccaaatcaagagctcgagcaataacaaatcgttgaactggcttaaatccatcaatcatgtttgggatagcacgattttcaaccgtgtacatagcataagccaatgcttcattatcaatgatactttttaaatcgcgattattcagttgcataaatttaccatactagtgaatgtagtgccataataacatcagaaatgaaaagcacgacttgaattaatccgaacattactccataatatagtgctaccaataaagtagcaagggctagtgaatagcccaagattttcttaatcattagtagataacaacacaaatgttaaatatgcacacataccctgggctaaagcttgtgaaaacacactgctagcatcgatacagatagttaaaacacatgctactatccaacaaataaatgaaataactcctaataattttgcgatattcatattttcctcactggcgtccgaagacgcctttagttttaagattgttgcgatagaactgcatcacatgttcgttgtggaaattactcattaatatgcctgcaaaacgaatttaaagttatcagccaacatacgattcatttcttcaagtgtttgatactcggaatgatgattacgagtaaacgctaaagctaactgtccttttccaaatcccgtcgtcagaggtttcatcttagaagcaggcagataaaatactgtgtatggaacattgttatttgcaatagtacgtgcaagctgagaccgacgttgacgaatatgacttagaactgcgctgaatccttgcttagaacgctgattacctacataaaatcgtgcagacacacatggattactaaatggacgaccatctaatttacttactaaaaagtaaaatccaggtttagataaaatgtctttatgtggatttcccaaaaaccactcaccgcccttgattgtaccaataacagtagcgcctgcattattcagatcagtaacagtcatatatttcatattaatttcctctaaattattttctactccaagtccgcatgaatacacgcggccattaaattaatcgtcgcagtcgacgctcaattcccaaaactcttctacggtataagtttcagtatcattttcaatacagaaacgttcattactgttatttgctaaagtagcgttaactgtcggtttctcgctagtgctcttaagaggtgaaatacgaattaactgatcaccgttatctaaacagaaaatttcaccaacttttacatctttaaaacttttcataattcacctcaaggagtataaaatccaaatgcagttgttgaccatcccatccaatatggaaaatttgcaccaatgtaaaacataagaatataaaaccaaccgctcagcaaattcatcattttacaccattccaaattgtttcaaccacggattttaaaccattttgatgaatatccattccgactactgccatcaaatagattccaactacaactgaacctaaggcaaaaatcagcatgaaaatgaataaagccggaaaaatattatcgaaaaaccattcaataaatgtaaacgcagtgcttttacgcttcatattttcctcacataaatccaaagtaaacgtttaatacatcaatcattaaaacgattgggaatatactcaaaactattagtattataactacattccatatagctttaataatctttttcattttctgttcctccgtagttgatagggtaatagtaccacggaagaacagtcttgtaaacaacttttttaaaaatattcgtaataaatgtgaataccaactactaccgctgaaacctgtgcaacccaccacgcacaagcaataagtacagaatttaaaattttcataataacctcattacaaaagtaaatgttaaacaaattactggaatactaattaaccaaacaaaacaccaccataatgaactcatagttcaatctcaacgatttccaagtgtttttgttttattgcctttttaacacaatcatggactaaatatgaccatgaatcattatattctccattaactaatcgttggagatcttcacgtgatgataagtaaggttgatctgattcccattttgataaaaatactgcagtaaaaatatctccttcatctgtagttgaagtcgtaaatgcaataaattcaccggtaattttatgtttagcgtaataaaatttaaatttcatttttactcctccgtagctgatagttgtatagtaccacagtccttgtggtatgtaaaccgttttgtgaaatttttaaatggaaagataccatccgttgtagttgctttttcttacaaccttacgaaggtcttctctatcaccgatgaacttcggagtgtactggatgacacctggatgaatttctttggtgttgaatataattatacagtcagcgacctgatgatttagaatgggccctagatttattccagagccatatggatactctccgctgcatcctgttgttacagaaatccaacgtgagtcagtttgatgtgtcttaacttctacacgaagcccgcaatatcttggatgcgccaatacatcccatgcgtatgtatatgggtcattaacatcctcttggcctttgttaacatacccgcttagccaatctgctacaaaaaactctgcgtacaccgcgatacggcatctttcgataacttctgctttatcctgatttggattttgttttaaagagtatcttgctgtatcagcaattttgaccttcatttcactagtcaagtcactattagacatggtaaatgccggaatctgaagtagtctctgtaaacccggattcgttttctgcattaaacttttccttttacatcggaattactgatattcatataataaatcataacttcccttaaaacaaaagggccgaagcccttatttgaattgtgcaattcttttctctaaacagtctgcgtaagatttcattgagataaattgtgaaagcagcagttcttgctcaacttcattaatcgttagaaactttgcgctttctaaaaatttactcagtgcattaattttgagcattaattgatcgtattcttcttttactcgtgcttgataacctaacataattttccttaatgtgataagggccgaagcccttatttaaattgttcagtaacgtcttcaactacttcgtattggcaggtacgcattttagcgtcgttgtaatcaatcggaattgatactacatcgcgaggatgaactttaacttttacaactcggctggttgaactgccaaaatgacgaatataagatttagaacacacatgcagaccacgagaacaagtttgtgtatcatcgtcattcacacgagtacgcggcattttaactactttacccggactgttatcaaaggtgtttgagtgacagtcaaagtagttgtcacgaactactttccaagcatagaagtaaccatcttcggtgatttcaatatcgtttgctaccaagaaatcaaaaagtcgagataccgctttctggcttgggttttccagcagattttccaagaacggaaaataaaattcaaagttttcgcctttttccatcgaatcaagaatacgatcaaccaaaccagaccgcaattcaatattttgatagaataagcttccaccttcaattcgaacatcgccggaaatatatttttcaacagcgcgacgaacattaattttttgtgccgcttcttccagcttatccgctacaagcagattgagaatttcctgaaagtttgaatgagtattaggtgttgcattataagttacaccatcgacagtaatcgaaatgaattttttagatgcattccaaataatgtcagatttagtaactggagcaataactgcatcgctattaactttaactgtaatatcaccgctaatagtaactttagagcgtttagcttcttcagcatttttcaaaacacgacggattgtatcaactgatacaccttgccaatcagccaattcctgctgagtataattaccgcttgaatacagtttaacaatttcagcttgttcgtttttggtcaggcatttaatattgtacataattttcctta

SEQ ID NO: 4 - DNA, 167483 bp, Artificial sequence
  Synthetic polynucleotide
  misc_feature: Ec45, E. coli bacteriophage
ttaggccgcaagggccttcatagttttagcgatttgagaaacttcatcatcacttaaagagttgcgataaccgatgaagtcggaaacaatgcggaatttcttggtaaactcagcaaccattttatcactgttttttgaagcattatttgataatacatcaaaaagattagttactgtccagatgtcatgaccaatggtatcttttccaccattaaaatatacaccgcgcaatgaactaactatattagcgagtcgtgtatattcttcagaaacttcatctgtactgaagtacttcatcataaaatctaactcaggatacttgataattttatcaatatatcgttgagctgaacttgaataacctacgtacttatcataatctacatcatcaaaagcatctacatataaatcacgcagagtttcaaaaatacattggcactgaccgagttcttttacctttttctgcaaaagcggacgaataacataaaactcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagcaaatcaatctgcgattctacttctggattaataaacagaaggcgttcgttgtgatgaatattcaaagtgttattaaattcactatcatctaacgcatgtgctaatccacggacaatattaacacgatttttaatattatcaataacgatattaatttttgttgtattaataccaaacagacgataacttgatgcaacggctgaagtttcatggctttgcttaatgcgtttcagtcgagggtcaagatttacttcatacacaactcctgcattgcataacttactatcaggttcaaacatgctttgcatcttcttatagtttcagtcgagggtcaagatttacttcatacacaactcctgcattgcataacttactatcaggttcaaacatgctttgcatcttcttatatgacagatttttagtcgtaaatttgactgaattactaatcatataatctcgagcagaataccccatcttcatcaattcacgatatgtatgacggggagatgtggattctttaaatcgttttacatcttcattaaatgctttctcactgagttctttaactcgttcaataatatttttacgagtacgatcatccagtgaaagagcctcgcgagatggagcaatatcaagtgaacccattggaaacttaatgtaattcacttcattgcgaatgcttagccagttacggtctctaataacaccatcgataggataaacaataccgccatagatagcatataatccaccacgatcaggccagtatctttctggatttacaccgtaatagtcatcaaaatccggaaaataatcaatttcgcggtcaagaccattaatgatagccaaatctttgaatggtcgcatgatataagaaacttcataagcaaagtttctaaagtctttttcttcaactggaactacgatttcaataccagttttatcatctggacccatttcttttacgaatgtaggtttaatttgtggaccatcaccatccatgtaagctacataaccacgaatttcacctttatgatacgaagtaatactaaatgtatcagtataactaaacggagatttagaacctaaaccaaacccgccaataaagtcattagattcagccttagatgaactgaagtatgaattatataacccaggagaattatcatcaccctgaatatcaaaatcactcatacccggaccaaaatctcgacaaacaaatcgcggatctaatcgtcctggaacttgtatgataaatttttcaggatttccattaagtgcatgggcatcaatcatattagtaattaattcacggactactgcacgaatcttgtttgtatacaaatcagatgacagaattttaaatactttaggagatgctgtgatgctaaatgcttttgatttagaaccattgccaagaattgtttctttttcagtggtgataatcataatttcctcattaattcatattacgcttaataacttcagcaacttctagtaattcatctttagttgcagtgtcggattgaattttatctctaatatctttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactggattttgaatcatctcacgatattcagatttttccaaagagccaagtcctttaatataacggatgctatgtttaggtagagcatctttagcactctcatattcagcgactgtataaaaccattcttgttttttaccgacctgagcgatgattacaggagttttgacaaaacgaattcttccttgctcaaacagttctggccaattactaaaaaacccgagcagagaaggataaatgcttcctagaccatcatggtcagcatcagtcataatagcaatattatgataattcaagttttcagctttttcaccgagaactaatccagtgattgcgcaaatatcaaatagttctttgtttttaagcatatctgcataagacataccccaactgttgagaactttaccgcgcaatggataaccaccgtgaagttctttatcacgaacatcaataagatatccgatagccgaatcaccctcagtcaagaaaagagtagtgtcagcatctttaccacaaagattcgctttgatatgtttatgaaccttagctttagaagcctttttagctgctttagtttctgctgctttttctgccgccaatttacgagccaaagcagcttcaataatcggcattagaattgcttcattatttagaatagcgcgtgaaatctttttagcatcaagttgaatatgactacgaatttcgccaaatggagaagtcaaacgctctttagtttgagaatcaaatcgcatgtttttcatatcacgaacaaacataacgatagtcaaacattctttaacacgcgctttagttacatcaattttgaacttacgtttgatttgtggaataaggtcttcacaaatatcatccataacacagtcaatgtgatggccaccattcttagtgtgaatgttattgacgtatgttaattgacgaaaaccatccggtgaacgaccaaccgcaatagaacaattttcttgttcttgaacgatagcatgctcatcatattggcgtgcatatttcttaaaattgccctgaacctttttaccattaaaggtaaattgaatatcaggataaactactgcaagtgtctggagacgatctagtgtaatgtcaagataaacttgggacagctcattagtttcaaatgacataaaatcaggaatgaaagtaacacgagttcctttccattttccaggaatagtttcccatgatttattttccatgccatttgaacaacgaactacaatattattttgaccatcaccagtttcaccgacaaacatcacagaaaaaatgtttgtcaaactagaaccaacaccattcataccgccagtgacgcgttctttatcatcaccgaagttaccacctgcttttggaatagtccatgcagcaacaggaccaggaatttcttcaccggtaggtgttttaaccatcgcctgcggaataccacgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccactacgctttttgatatgctcaatatcgctcagaattttaatttcattcttaatcatcacttatcctcgtttggtttcgggaatattatactccggtaatcataaagctaaaggcccgaaggccttttatttaaaacgaatagttgaatccttaaagaacagcccagaacatactgttccttctactttctgcccggtaggtccaatagcacgaaatccagtatgctggaaatcattttcagagcaaccgaaccagttatatccagtgatttcaatattagtaaacccacttgaagacaaaactttggttgcattatcagcatcagtacatcctactaaagatactgctaatactaatgccgcgatagaacgattaacatatttcataattttcacttaaatttaatggcttgaagaagactaataactctcaagcgacttctttcatctttaactgtaaaagaaagagggtcaccagacttcatagtaatagtgcattcaaaatcaaaatcttcggaaacttctttgaagaagtcaaattcttcatcataaattaaaacttcactccgaagactgtgaagagtttttccgtcatttccagatgctgtactaatcattgtaacattattacctttcatatcttcaacgataaattcgcttgtagatattacagcattaatagaaccattcctataaatagcagaaaatagatatttcttttcttcaccttcgcgaatgcgatatttcttaccgattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccacgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatctaatagccattaataaatttccttccagtaagttgtgccatcttcagtgatttcacggaatacaccataaattggttgtttatcaccgactttctcatatacataaaccgaagtcaagtgagtaaacttgatagtgtgttccttttgaactactaccaaatctggatcgaataatacatcttcaaattcatcattagtgcaattctgaacaattttacgtttcatcataatttcctcattaattgaacattggagcgatgcgtttcagaagagtatcagcgcacctttaacgaattatccattttattcttcaagttgttttctgtatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttctacccattgatcagtaatgtatgcacacatagcgcgagtacgctgaggaagtggttgtccaccttcggtaaattcaaactcataaggagcaatgaacttgatagcttgaccaagtttccacttaaagtctacacctacatgcgaagtatcaatcgtttcaattcctttagcaggaacagctttcaaaaacgcaggctcaagaaatttccatcgaacataaccaaactggggcttagacattccatctttagcaatgatacgtacttttacttcagaatcttcatctttaacaccgtgtttaagctgaatgcttacaacttcgaccaattttcctgctgctttagaacgggatttatcagatacacgagcaatttcaccgatattaatattcataattatctctcacttgttaaaaagattttatactccacaggaccattatactctggtcccaagagtttgtaaactagcttacacgaacattaatcactgcgctacgaggaactacagagtattctccagcatgaactacgttcagaagttcaacgccatcttcaatccactggtctgttacccaaccacagataggattatcaaaaggacgacggatagacacagcagcacacaacaggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcatagtaggttccttaatttccagtggtttaacagggcatacataagtgcttacaacatcaaaatcaatcagtttagctaccggatttggtatgtattcaggattataattaaatttcataattatctcatttcaataaaatctacgagttcagcatgcgatttgcggaacattacttggtgcccaccaatgataacttcatcttcaggaacttcgtatacagcgagataaaatcctttagaagataattcttcccgctcttctcgtgtgaaccatctcatcatatcatattcactagcgaaagcaaaatgataaagacctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacgtgtaatagccactcttcgctacatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgacggagcatcttcaagacccatagcatatcgcaaagcatacttcatcatcagaatatctttcgcacagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatatgtcaagctcattctcagaaacaccattaagacgttgaatatcacgaatgagatcgactaaaattggaaaatcaaacgacattccacggcaccagccctgagatttccaaggatcaatgttatgcgcattgatgtaatcattaaattttgcaataccatcgatagtgcttacatcttcatctgatggtgcaatattttttcgagcttcaggagattggttcttccaccattcaatagtgcttttagtaaaaagacgatgtcctttttggctttttaaatcaaatttgattttaatgccacgtgaaactaattcatcgaatgtttcaacgacttctggattagggtcaaaggcaataacagccaaatcaataacagctgccttttcaccgcttcccattgtttcaaaatctataataaaatcaaacattaaattttcctcgctaaatcgcgaatttggcctacagtatagtcttgaatataaactttattaataggttcatcaataaattttgccatagattcaatatctttttgcatctcttcaagactgtatattatctttaaagctttttcgcgaatagtaatattttcaggaccagaatttttctcaatgacagctttaacatttgtcataagagatttaaattggtacaaacttaattcaatcattaataaccgccttataaagatggctaatttcacctaaaacataatcactgattgtgacagttttcacttcaccacaaaagaattctaacgcaattaaatctcgttcaatttcttctaattgaagcatcaacttactagattcaatttttacagtttcacgatttttactataagctatttcataaatttcgctcactttatcttgaagcagataaaactggtctttagttatttccacgaatagcttcctcaaatttaatcatacataaaacacatcataacgaccacgggtaacaccaacataaagaagttgttgagccaattcagcatctgcataatgaatacaaggcgtataaatgaaagcacggtctacagacatgccctgtgctttatggaatgttgatgcaggaagtgctttcactttactaaactgtgatttagcatcccaaaaatcactccatggagcttttccgcctttgttccaatttttataagtttctgccgttttacctaaaaataggttaaacttatacagttcttcatcagatgaaattattttaatcttttcacgataatattcatcatcgccataagtttctactgttaaatcccaatgacgaattaagtattctccaggaacaccacgagctttaacaaacgtcgatgtatactctgcttctataatacgaactaattgtccgttattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagagatttgacgattgaaaaataatttaccataaaatcgcgtaaagcggtatcacctgtaaatccacgtactccatgcccgtcaacaattttatcataaatccacttaccgttacgaacgtcagtagctacatcaataataggagcattactgcgtttaacttcagtgagttcacactgataaaaatctttatgtgtaaagaatggactgatataagcagtgttttctcctgggtcaacaggtctaatctgcttattatcacctattccaattatagtacaccacggcgggatagttgaaagcagaattttaaatagctttctatcatacattgacacttcgtcgcagattaataccctgcatttagctaaatccggtacttccttctgttcaaaaagaacgttttcttcatacgtaactgggttaattttaagaatactgtgaatagtactcgcttctttccctgatagttttgaaagaatctttttagctgcatgtgtaggagctgctaaaataataccagtttcacccgtagatattaaagcttcaatgatgaacttagtaagagtagtcttaccggtaccagcaggtccattaatagttacatgatgtttcttttctttaatagccctcataacgatgttaaaggcatttttctggccttctgtcaaatcatcaaatgtcatcggaaagtccctgcaattggaatactaacaatacgcccagtatctagaattcgttgatataatctttgtgtatctacatcaggcttaacatgtttaacttctattttattaaaccaaaacttgcgtggagtctcaactaatcttggaattcccttacctaaagctaatcgatactgctctttgagagtagtaaaaactctatcagcaatctctctttcaaaaaacacagcaggacgatgttcatcaagtggaactggcgccgtaaatccgtctttgtctcggtaaactatcgcatatacataaaccatattatcctcggataagtttaaaaattgaacaatttagcggatatcctcttttcagtttaagtttatcaataaaagacaagttttgataccgctctacaccttgaataattttatcacacatatcatattgcatttctgcttctgacagctttttcacaattttccaatccgagcctttaagaagaacgttcaatttaacaacttcagcgccttctgctatgcgagaaccatcaatacgtgctttaagtgctataatccttagcttaatgtcagaggtctgttttgatttagaaagctgagaaatgtgttcaattcggttttcacgttttttctgtatagctttaatttgattataagtctttttgattttagcccatttcttttcatctaaatttagtttatgaacttttttcgcagatgaacaaccaattcgcaaagcaaataaatcacgcttttcaatcaactcttctaaagtataatcagaacgaaatgtattgtactttttctttactgcaataacattccctttaatgtatccaacgttattatcaaaacgttctaatgataatttctctccttcaatacgattatcaaaaggttctcctgaataggcacaaactttttgttctaaaatattcttaatataattgaagtctaagttaaaatctttagaacgtctttttgcagatgcctgagtatgctctagacgacgtttaattttacgaatttggttattagacagcttcatatttttctcacatcttacggacggttaactacttatactataacatttttaccttaacttgtaaacaactttatgtaaaaatgctttaaaactttcatggtataatgaatctaagtccttccattatagattaaatccttcaaaatcaagagtatagatagtgtatgttgaatactttttgtactcatatctatctgcaattctaaatacacttccagctggtatcattacttcttgttcatctgaaactaattccatattacgataacgatggctatccggaaacttaaagtttggattgtattctttacaacgtagagcttttatagcatactcctggaaattgaataccataggagctttgaattcaaaaataacttgtgtgttatactctaaaccggaagcaaaatgtagagctatatttttatcatatgaagctgatacgactttatcaaatgtaataatatcaattccttgatttaatacttgcttagtctcagctggaacacctctccaaagaggtttatcgtttggttccaaacgagatttgattatttcatttaaccaagtatggtcatctggtttattagtaatacaatgaattaaaagttcaatttcagataaattaaacccttcagaaagtaattcttcacgaatagaagcacgcaccgatgcatccattgattttattttaaaatcttttagttgcattactgagtatttcattcaactacctcaatatcataaactttaaatgttccaaatgaatcgtgtaatttttcttttgaaatagaagttattctatactttccaattggaatcatccattcttgttcacgcacaatcatcattaagttatcagtacgctctgaatctagcccatcagtatcttcatacgtgtacttaaactcagtattaggagaagaaagtataatatcgctgatatggtcagaataattaaaagctttatcagtttttaagcgaaatattatttcagtgaaatactcaacataagaaaaaccacatgctgtgtgcaaactagtagtaaatgaatctaccctattcgttgaaaacacttctccaacttgtaaatctttaatgagttcttttgtcgattttgatataccacgatataactgataaggtgatttagttaaatgctttttaacgattttattcaactgccgatgaagagcttcattctttttagcttccatacattgccaaagaattgactgctcaaagtcagtaaatttttcacagacttttttatacatatcatattgaaaatcaacgctttcagcttttatagataactgttcaacatctgcaagattaataatcatgatagcctccgtatacttcagaagctatcatatcatcattagaaaggaaagtaaacaactttttgaattattttgcccagggagcccaaggcggagggtcaagatggtatgaagctagttcttctagaagagcatctggggcttcaattccataattctgtaatactatacggtactctttcttataatcactagaatcattctggttattcgtagaatgattatcttctaacatctcaaataaatccatattaattcctagcgataaaaaccaaattgacgattagcttcaataatctttctttcttcttcggacattctccaacgtagtccaacatcaaaatgagcccagaccatcttaacaaatgcatttatatctttaatatcttcaataatgaatgttttacttttagaaggttgactcactaatttaactttatcatcttcaaacaggtcaaaaagaccatattcatgagctcttttatagcctttaatagttaaagcttcagaagaagaaaacggtgaatctgtattctgcaaaatatcttcagtatgctttataattagaataacattttctggatattttctttcttttatatctttaattaaaaaatccggattttctgctaaaggaataattaatgagcattttttaccaagagtatttactgatttaccttctttagacatgaattctactgaataatgttttgctacttcaatcatgtgatttccttttgcctactaatggaccatcgggaattttgttttcctggatatatttctcattttcttccatcattttactgccaattttaagaagcaaatccagtgcttcatttgcttttgctttagcctcttctaacgttatatctttgttcatgatttatcaccatagatgtctctcatcaatttaagcgctgagcgttctaatttcttttctttctcagcactaatcattgatttcatccattcttccgattcgttctgcatttctttatttgcttgttcaacccaaccatcgtcaatatacattgagtttggtctattgaaccattcaagaatcttcttgggagctttcatttattttacctaaaacaatagtaggagcatcgtcaaatttatgaatttttagtaaatttggatttaacttattccataaagaggtaataaaatatgatagcgcactttcgtccgtaattataaatttatttcctttatctattttccaatcatatattgaatcatatgaatagaaggataacggtttattattataatatgcttcactaacatcaatatagttagatttagtaaatgcttgaattgccataaatggagaattttgtacagtttcaataattccgatctttttaagttttatttcaacatcttctggaattggcattgaaataaaatcttctactagatacatgttattgtcatatcttttatcaatcattactgctacggtaattggaacatccttgacaaacgccatactaatactattgataaacatttcaaacaaaattgcttccataattttcctcaatcacaagatgtagatgaacaactagaatcacaagaacttccacatgaatcacctgcccatacgtgaacaggaacatttgtatcatatgaatcagaactagactgtgttttctgtgcattagatgatgtagtaggtgttgaccagcgccaaggatttttataatattcttgggcttcttcataagtcatagtaactgcttctactgttccatctcccatataaacatactcaactacagttaaaggaaggtagtcatttgaaataggaactacaccttctccgggagttgtagagaaaaaatctgtaaagaaacttttaaaccaattaaagataaacattacaaaaagcctttcttgaattcgacttgcttctcaccataatcatatcgaatttctgcattaaattcgacagaaccatctgcgtacatcataaatgaatgcacaacaacttctgtagaccatggttgtagttcatatttcttcattacgtgtcgtgaaatgataatatctaaatcttcattcggtttaatccaacgatttaacatagcgctctcctctataagataattctattataccatactcattttggaaagtaaaccatttaaatgaaaaaaggactcccgaaggagtccttgaattattaaccaccagttactttccacaaatcttcgtttgcagcaatccattcagtacgctgattttcttcatatacagtagtatatgctgctttttctgaagggaacgtctggtaatgagcaccagaaattttgtgaacgtcagaataaagagggaaagctactgaaatttcctttccttcaattttcttatttccatctaatttctgctcaaatgttttgatattaacataaccgcgagtactagccatgtaattctccttttatttaaattacatgattatttataataaattctcgcggcttttaagacgagctgttaataacctcggtcttgacgagcgaaattttcagcatttttcagataataaagtttaaagatttcttcagccgtaagaccgaggccttggaacatgttcagaacgaaatgaagaatatcaatcatttcgaatttaatttccaactggtcttgtggagacaaatcagtaatcagagtttcacgtcgttcaccatgttgagctttccaaggcttccatacagcagatgcatctttttcaccattgctcataccaccaagagaagtcagaagttcgcggaattcatcatcaatataatctttctgattacgcagccaatcaacaacttcacctgcagtagccaaatcatcaggatgacggttatattcaggtttatctttagctaaacgaatctgcagagatttctgcatgtcaagcattacctgtagcgggtctttttcatcaccgagaatatcccaatattcattttgagctttatcagcgccttcgatcagttgactacattcgttaaagtaagccattatttttcctttcaattcatcaataagttaaataattatatcatttgagtatgtaagcaattaattaaaaatatatacttcatcagttccattcttttctttggaatgatatatgttaaagacgtattttttattaagatgcttaacattatattttttagaccattctttaagaagagtgttttcctttccgtgatgctctaaaacattcgacagtccaaattttattcctctgtcatttaaagaatctaaaagatttaaaaggtctttttcttcttcttctgaccaaaatttattataatcagcaactgttataagatatggagggtccacatatacaaaatcgccgtctagaattttgacatctttaaaatgcaatgaactaaagattattttatcacaattttgtttaaagtgattaaagcgtttttcactatttttgtttatagttctttttccaaacggagtagtaaaatttcctttatcgtttatacgaatcatattactaaacccgtgaaaatgaagaacataaagtaaaagaggatctctagttttattataatcttcacgtaatttcaaaaactcttcttttgatgtttttgatagtttatattgctttattacttttaatacgtcatcccatgatacattaataagacgcttatacatttcaataattggttcttgaatatcattggccaatacaggaccattgacgttcaaagacactgataaacctccacaaaataaatccacgaatctgtcatattttggaaaatgaggcttaagttcaggtaataatgactgtttattacctgtatacgcgatagctcctagcattatattctctcatttattgcagcaaaaaacgaattatataattcttcatcatatgtatttgatagtaatactaacacgttttgtgatttagcatattcattaaaccttgcttggatggttggattatcagtaaatgattctctttttgtccatttattacgtggataatatccgcatggcaaaaaatctaatatcatcaatgacacagggttttcagtttttgtgtattcttttaatttctctttatcttctaaatatattccaaccgaatcaatagctgtacctccaccaacttggtgtttaatttcaattatatgctttttaccgttgcgagaaataacaatatcaaatcttctagtacgcttcttagttataaaattagaacaaaacaaattatttgatttttcagtatcatcggttaaaaccattttttcttgataactaactgaacaatcagtgaaatattcttttactttattaagtatgaaattttcaactacggcagatattttatatgaatctccgtttaaagccatttcatgcacaattttattaatcattatatcatcctcagcaatttattttataataccataacaagctgagaaagtaaacaaatttatgaaatttgtgataaatattaatttaaaggaggacatatggcacaaaaattaatggcacttgttaatgccataaaaggtaataaaaaacgtatagcttttactatttctgctatggtaggaattttactctggaactttattttatcaccaattgcaattgcgcatggtgttaatattccagtagttactcttgatacattcgtagatctagcatttgctttagttgggttaatttaaatcttggcatatttagataaccgcattttagccattaacccctgggcaatattatttttcatatattccataatttgttcaggggttgcaccttcctttctaatcatatcattaacatcttttgatttccagggagatttatcccaaaacataaccctttctcctgcatcaactaatttagtcattcgcttgatagtgtcagggtgacgaggctcattatctaaaacccacactcgtctatctttaaatggaacaacttctaggtctaattgaccacccgtaatagctataccattttcaataaaaagtgaatctataggtccttctagaacatatacatcaccatctttaactcgttcgactccatatatttttgttgcctcaggataagctttgatggtgatatatttttgaggagcatctttctttaatgcacgtccttgaaaagactcagcttttccattagcattataaattggaataacaagacgaggctcagaaatttcctttttgtatgttcccggtgctatgctattaactaatttaggccattcggttgtaaaccaaagatatttccatttatcctttggaatacaacgagcttttacatattttataattggatggtcttccgccagtttatctaatctaacacatgacggaagagatttaattattttcttctcaggatgtttaggaagttctttaggtttttctactggacgacttttacctttttcttttcttatttcaaagatatactcacgatataaatcaggttcaaactcctttaaatatattccgattggcgcatgatagttacagttataacaatgaatatttccttcattattatcaccataataccatccacgcgctttattttggtcggtttttgaatctccacaaactgggcatctaaaccgtaatttaaaagttgaactattatttacttgtgtgaatttaggtaaatgagctaatgcacgatatgcaaactcattatcaatccaagctattgatgacattctttactcttctttttctttagattcctcttttttctttttaggaatctgttcaggacctttatttactacagcacctgatgttgttccagtagagatattttcaggattaccacctgaatctccagcaaccatatcttctttaataaattctttatatgttttcatattaacctctattcataaaagcattaaaaatttggtcatcaatagatggaatagcaaccttttcggcatcatttagcaaatcattaatttcatcagatagcataacacatgtgcctttatttcctgtaattgttactgcacaattacgaacgttttctttattaaattttaggttaatattttcgtaatgaaaatcctttaatgctgaatatatttttaaaataaaattgtcttttactacaataaacccaacctcactattaaaacgtggttcatggaaactgtaataaaccttttcatctataaaatcgtatgaaattttttccatttttaaatatgaaaattcagaactatacatactaacctctaattactcacctaccacttcagcgatgatatttttattattaaagtttttatcgcaatacagaacataattatactgcattacaccaccagatttaagttgtttttgcacttcagctttcatttcaggacgatcacgttcaacgatattcataatatccgcttcaatttgaatttcaacttcagtctgatctgcagtcatagaccattcgcacaaatctttgtcataacccgccatagcaggctgagcagcgcaagaagataaagcaaaaattgcagcaaagataaattttttcatgataatctcctcagtagtttatgtttatatagtatctcaatttccaataaaagtaaacagttattttaaaacttctgcataatcacatgttacaaactgtttctctaacttggcgattttacgaaagtatcttttgcattgacgaatctgtcgctttgtagggcgcacagcaaacttaataaattccactcgaccaaatggagggctttcttctgccggaatatctaatactaattcccacgtatctgcaataagtgctttgaattgagtatttttcctgacattatacggagtaggtttaaataaaacgatatgcatattatcctcggcaatccacttcacataccttcttgtcatcaatgaaagctttaactagtgctttattaacttcagcatattgagtagtagcccattgaacgtcatctttcatcattgtgatctctttagtaaacatgctttcgttcttaaaccaccccataaaaactacctttaccaattccataacaatctcctcatttaaccaacaagactactataccatagtcttgtcagcttgtaaactaaaattttaattcatttgccaaagcatctaactgagctcgagcggattcgtttctttgatagcgattctgttcagcctgaatttgctgtgaacctgctacttcgttcacttcagttggagtagaatcttgttcaatttctacccatttctgatttcctttttgaacacccatcaaaaacttattccatttattcttatcaccgtatcgtgatttgatttgcttaatgagttgttgttcagcagctgctagctcctcggtttcaatgaccgcaagcataaaatcagctgttgctggaagaccggcagattctgcaatatcgctcatgttaacatcagaagaatcccaagcttgtttaccaacctgtgctgcagtccaaagaacagtttcggtttcaacagcaagagcacgtaattcctctgcaatggctttaacagttgtgtaactattttctgagtaaactctaatgcggcaagatttacaaatacccagatagtcgacaataatgattgttggaacaaaattcttcttgagctttaattcgtttaaaagcgaacgaaatgtattagcatctgctccaccagtaggatactgtttaactattaaacgaccgagagtagatttctcgcgccatttttccatttttcctttatactcagcgtaagaaatatgcccgtcatcaatgtcatcaagagaaacatcaagcatattagcatcaatacgcttagcacagacttcttctgccatttccatggaaatgtaaagaacattatgtccgagctgcaaataatctgctgccaatgaacacagacctaatgacttaccgacgttaacaccagccattaaaacgttcagtgttccagtttcagctccacctttagtaattttatttagaattttgagtctaaatggaaccttacgagctttattcatataagatagccaacgtgcttcgtagtcatccatccaatcatgaccaacgtaactatcaaatgaaattgataatgcttggcgcatgatgtcaggaatagcacctacatctggcattttcttatttcgtttttccggaggaagctcagcattagtttgaatttcaattattttagacgtagcattaaacatcgccctttgctgaacatatttttctgtttcttttactaaccagctatggtcttctggagaatcggctagtttcgaaataagtgtttttacaccagaatattctgtttcagtaaatgaactattttctaatgcaacatttaacgcattaatagatggaacgctatggtactcattaacatgagatttaattaatttgaatgtatttttagctggaccactttcaaaatattctgaatccatatatggccaaacttttgaaaaataagcttgatcaaatatgagatgggaaagaataatttctaccacacttactccttaaaagaatttaaactttttctttgaccttttattgaatgcatcttgcagttgcattgtaatacatttttctacatgaggagctaactcagcttttctttcttggtcaagaacagcaaagtccattacaacctttccatcaacccaatccagtttagttacatacactatatgtgtagaaccatcttctagtttaatgacaatctcctggataacattttccatagcggatttaattatcttaagagactcattaaaaagacgttcttttctttcttcttccccctccgaagagggagattcatcgataatttctagatctaaatctaaatcatctttattcattaaattcttccatatcacttaactgttcgaggtcagtttctaaatcagcagctgatttacttttactttctggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttagtatcttttgcacgccaagatttttcttcgcgaatcatctcgccggtttcttcatcaagaaattcacgagcataccagccatttttaggttttaccacaaatcctaattcaagagccatatctaacaatccagaataaggatcgatgccaccgtcaaatttaacatcaataaagaatttacttttttctttaacggtacgagatttttctacatttagaacaaattgatacccctgaagatcagaaccatctttaatctggcgcttaccgataatgaatacagtatcagccgaatacattacgcctgtaccacctgtcatcacggttttactaaacatttcaattgtttcaattgtatggttaaccgcaacacatggaatgtttttaatactaaaataaggagtaacaatacggaataatgacttcagtgatttagcacgagtcatatctgccacagatttttcattcaaggcatcttccgtttctttcttagaagccatattaccaattgagtcgatgaatactataaccttttcaccacgctcaatagcttcaagctgattcaccatatcaattttcagctgttcaactgattgaattggcgtatgaattacacgttccgggtcaactcccatggatcgcaaataagctggagtaataccaaattcgctatcatagaatagacaaaccgcgtcaggatatttgttcaaatatgccgcaaccatagtcaaagacatatttgatttaaagtgtttagaaggccctgcgaaaatagttaaaccagactgcataccgccatcaatcgcaccagaaatagcaatattaagcattggaatttttgtacgaattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctattggatgaatagcattaaacttatgaaatgcttctgatttttctttacgcgaaacgcacatgcgaagaacctttaatggctcgtcttcttcacccaacgattttcgtttttcaatattagaagttttccaacgagcttgctctggaaactctctattgatttgctcaagcgctctattatgtttagaattactacgaattgaactacacccgccaggagcttgtgcttttccagatacaactagatatttgaacaaggccaaatgcggataaccttgattaattaaattgagaaatgcatacatatcttcgcataaatcaatttttccatacccaatttgttctgtcgtaagttttccgaggtcataccatgtattcgtgaatccatatgaattttcacgataattaccccaagatgaagtaattttaaaaattggtagacgagcatgaccgtgataatacccgcaatccatggcatcttcaacatattgaatcaattcatagaactgttcacgagttaattgattaattttatctacgcgccgtttatcgtctctctttcgtattgaactcatacggatagtagtatcatcgtcaatcatccagattcgttgacctgcatacatatcagtaattgctttacgagtaccggcaattccattaacatcatcaggaatagttacaattttagctctagacccataggcatcataataagctttttcttcgtgttcacgcactataatatgcggttcataatcagtcggaaacatatcaagggcagaaactgccccgacacgttgataacttggaattacgaattgaatcatttccactcacctttatagtcttttttcacaatatgagtttcgccagtattccaccaatgatcaaccaaataaaaatgacgagaatatacatgaagacttccaacattccatataatagaacctgctttatactgacgagttgaatcgcctgcattcaaatcagatactaatttatctaatacgtatttttgccatgcataatcattacggaatccgaagaccacgtcatttgagcgcatgcttactaccgcattgactttcttatcacgaatcaagtactgtactgtattagtacacatgaaatctgacataccatctttattgtagtcaaactgcatagatggacgagtataaatcatgataccacgtcgagaatcaggattttgaccaagttcagctaaacacatatcatactgggcatagttatcttctgaccaaatagcccaaccataattcgagttaatttcgcctttagaagatgctacctgctgccaaatctttggtgtttcacctggaatatctttaacaaacaaactcttagatttataccattcaagttcacgctgaatgtattcatcattaagagcgccaaaaataaacggttcatctgctacaaatgatgcgccaataatttcaatagttttaacaccagttttatcaactacgaaatctttttcttttaatgcaagccccaaatgaagacggatttcttcaactgtcatagagtcactaatcatttaaacctcaattgatacattcatatttaacttgtaacagtaataaactccaacctaaaataatagttggaatcataagaggaaccgttacactatagtatatacttattataatcatcaagattaaaagcaacactgctataattttgcttttcattccttctctctgatgataattacctgatttggttgtgcagactttttagtttcacccgcaattgaccaaataaatgtaataaaccaaccaataattgaccagttaaacagtaaagatgtgaaaaagattcctactgtcgattttgacccacgcatcaaagcaataaaccatggaagcatgtatataataatagccaacacgcctgaaactaaaaccataaaaattgaacctgctactaaagtttccatgttttcctcacttagtcaaattttttacgcatgaattataagaattcactacatactccatcggagcatttttaccagtacgccattggtaattattagcccaattagcccaaatttcggcgcagtagttttcaattttttcttcgtgtgtaattacatcagaattacgatatgcttgagcagattcatctggacgaatagcttcgtcaaaattcgcctgcatttgttcgactgtttgctttggagcttctttataacacttgacattaggattataaaatttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacggtgctagattcaatcacaggttgagtatcattttcaacactaacaaatggaactgctgctaatgcaactaaacaaactgctaagcatcccataacaattttcatttcattctccaaatccgtatcagtagttgatagttgtatagtaccatggaagaacagtcttgtaaacagttttgtgaaaattttttagggaattctaaatgtccagaatcatctgtttttcataagtatagatttatattacttgtatgaaaaagggacccggaggtccctagatttattctatcagccaaacaggaagtctaacgaagctttttcttcatagtccataccagccgattcacacatgcccgcaagcggtttaacaaacgatttttggaacaaagttgagtagtcaatccaagacagtacgtcagaacgaatttcttttggaagttctgtacccgacggccaagcaatgcatttgtcaccaaatggatttccttcacgcaatggaagaaccattactttatttccatccaaaattggagctacacctaaaccgctaacagctcgacgataagttagcacaccgcgaatatggaacgggcatttaaatcctggccaacctttatcatcatatttcgctatatcgttcgcagtttttacttcagcaataactttatagtcaagttgacgatattctttctcgaagttcttgtagtattcttggacagactcttcaccttcttgaagaatacgacgaatactttcttcgagagcttcttggaccgctttaggcgttgaactctgctgagtttccatacccatgatttttagatgcggttcagcaaatcgtttatcttccatatcataaacgttcagagcataacgctttttcgctttccaaaatccaccaataccctttgaaccaagtggagggcaagaaatagcttcacggtccatatgcatcagatgctcgcggttattcatataatcacataactcacgatatgcaacatcaatcataggttccatctttttcttaccgaactgattcatgaattcaactaaatcgttctgctctttgaatcggtcaagaccaactttttcaataactttatctacacaaacatataccgaatcagtatcacctgctgcgatgaaatcttcaccattagttccgcatactttattcagatattcattaattttacgagcaatccactgaataccaacttggccgaaaattgtgatagcagtagcatttcgcaaatcatagtaacggaaatgaatattaccaagagcaccataaagactgttaataagaattttacggttcagctgatttgtgttagcaagtgtagccgctttttcacattcttcaatcaaactattgagaacagattcagtataattcgatagttcatttaagaaatcatcactgaacttaacatatcgttcaacttctggtttagttgaacaagaccctgcgcctttcataataatctttttaatagcttcggcattcatttcttcagcgaacattttctttttccaatctttacgctggaaaaatactttagcgatttcctttggaatgataccttcttgatgcttatcgtacatccatccattcggagaacaagaatattcatcactcggtttaggagctgttcctgcgatatattcatgaattggatgaactttaaactgaccacgaatagtctcaggactaatgttaacctgacgaataatgctcggatacagagacgtcaagtcaaaactcataatatatcgacgagcaattggtttaggttcaaatacgaatgcacccggaaaactctgtttaacgtgcgaaccctgttgaggaataaccttatgttcacctttcaatgagttaaaaataatagcatcccaagttttaataggactcattacaccagaaaaaggcattttagcataataagacatacttaaaactagatcgataaacccgcgaattttatcaattgcttgaactgattctacgtcaatgatgttataactaatgtatcgttgatgattagtctcacgaagtttattaataggaccatcatacggtaatttaccttttttggtttcatgttgagcaactgattccaaagagaatgacggcaaattagtaaaagcgaatttcttgtacaaatctaaataatcaagaatagatacgccatcaatagaataaatttctttgctaccgtacatattttgaattagtttagattttactcgaccgattggagagaagcgtttcatactacgttcaccgagaaccattttaacacgattcatgatatacggaacgtcaaatccctcaatattccaaccagtaaaaatagcaggtcgtttctgttcccagagattgatatattccatgagcatatcacgctcattatcgaatggcatataaattactcggtcaagaatttcttgaggaacttcatcaccaccttcacagtcaagcttagcagctaactttgcatcccattttgatactgaaccgtacattgaattcaaaaggtcgaaaacataaaaacgatcatcaattgaatcataatgagtgatagcatcaatttcatattcagctttcattggatcaggaaatttatcaccagtaacctcaatgtcacagttagctacacgaacaaattttcggtcataaacaatttctgaaccatacgtatcactgatataagcgagtttaaaatcgttcataccaagagcttcgagaccgatgtcttccattcgcttcatccaatctcgagcatctttcattgatggaaatttttgaggagcgcaatttttaccatagatgtctttgtactttgactcttccttacaatgtctaaacatagttggaagatattctacttcgcgagtacgttcctttccattttcatcaatataacgttcaacaatgttatttccgactgtttcgatagagatataaaattctttcatagatattccttagtttatagcccgagttattaggctcttgatatattatactccaaataaggggccgaagccccttgcttaaattagtactatttgtcgggtgaaaattgtcaatccatctgcattaattgacttaacgactgcagtaaagtgtttttgttctgggtgaactaatttttgaaattctacctgaaattttagttgaaggttttctggtaaatcgaaaagtgtttctgttgcagaaagattatatttttctttaagagacgccatgtattcttgcggagttatagcagtcatattaattaccaatcgtatatttaggaacgagtttccattcatgtttttgtttaaaagaaataactcggaagttattagttaaatctttcataaaagttctttgaccaggaacgatttcaatcagtccccaatcttctaatagccatgcaatcgaatcacgacgaacttcatcttcttctgtcatttcaacctggcgaccatccatacgaagcatttctttaaaatgaacgatatagtatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaaaccttttagttcttttaatactaaaggaagttttccatttttagtaagaattgatttatagttaattgcatcatttgtattaacttgataccgcttagcaagtaacttaataatcaatacttcggtggaatcttcaaccagttttgcccatttaccatatcttttaccacgaggaactgcagccattagataattaaaatgagcttcatcacttaatccagaaccgattaaattcatagcatatacagctggcatgcactctggaaattgtgataatgcattttcaaccatgaattttgaataatctttttgagcaatagagcatttagttttattattaatagctccaattatttcaaaaaattcattttcagctttttctttaaaagaatcagcagcggattggacagctgtccaatcttttgaataccaagcaacttgatgctcgtttaattgaatatcatcttcaaataagctcatatcacttccactgcatttcgcatgctaattgaatgaaaagataagctaaatgcaattcagtattagctgcaataccatgatactgattattttcgcctacaatttcgtacatacgaataatactctgcggagttacacgtgaatagatttcttcggcaagtttaccaacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaacgtaataactcggcagcgtgactgaagtggtttaataataccatcaatattgttagcagtaataataatactacagtttgaactataagcttccataaaggaacgaagatgtcgctgagattctgctaaacctgaacggtcaaattcatcaataacgattactttttgacgaccatcaaatgaagcggcgctggcaaaattagtcaaaggaccacgaacgaaatcaattttacaatctgaaccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctctattaaaaatcatgggtagaatcagcttcaagagctactacataattcgcatgttcaccttcaaatttagcagcgccttgtttaccttttgcccaaagcagaagtttataatttcctggttgcattttcatatttgccatattgataatgaaattaaatgtgttttcaccatcataatcaccaagagtcaaagaatatttaacacgggtcagagcagaatcttctactttattaaaaccgttaattacgattttaccttcttttactgtgatagcaattgtatcaatctgcagaccgcgagatacacgcaacaactgttgaaggtcttcagctttaatttcggtaacaacagatgctaccgggaatggaattggtttattaggagcaactactgtactcggatcggctgctggccaaaaaattgttgaacgggcatcagcaattttaatatttccatcttctgactgggaaatttctgcatcatcattaactagcgacagaataccgagaaaaccgttcaaatcgtaaattgctacatcaaaatcaataacgtcagaaatatttgcttccgcgtaagttgtaccattaactgcgcgagtcataataaattgaccggatttaagcataatgccagagttaatagtagcgaaatttttaagcagagcagtagtatctttagacagtttcatgtaatttccttcaattcaaatgagatttaattttataactaatttaataaagcaattaacgattaaaatcagccgcaattgtttccgcaacaatttgagcagcaacaattagacgttcatctgcattaccgcaataatcatcttcaagacgttcaccacatgaagtcataataaatttagcaccggcgtttagggattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcatttctattggacattatttttgtatattctgctttaaatgcattcctaagcatagattcagtaactatatgctcttcattagaaaaattatttctcagaatatatcgttttatttcaggaatagttaatagatgctgtccggttgaatattccatgtttttcctccatagagattatactctaataaattaaagcataatctcttataaattaaaccattacagtaaatcgaccaactttcttcatttgaagatgctgaccgtatgcttgcgggtcatggtctctatgtgaaataacaaaaacgttagtattttttaaactatctaaaatagttgaaatagcttttacaccttcaacgtcggtcgctgaatcaaaaacttcgtcaagaattaacgtgtttattttaacacctgaaactttttcagcaatatcacgccaagtaaataaaagagcaatatcaattcgtgctttttcaccttgactgaatgaagcataactaaaatcttcgcgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagccgctttaacctttttagctttatctactgctgcgatcagagattgctttttattgcgaatatcatttgccaacgactgttgggttttaatattatctcggtattcatcaacaagaacttttaaattatcacgatgtgttgaaagctgttcaaacgaatgcgtacattcagaaactttatctttaattttagaaacaactttatcaccggaactcaattgtgacaaacaggttggacataatccaccttcgtgatacatattaatgactttattatacgagtcaatttttgatttaattaaaactgcttcttgaccgattttattaaatgcatcagtcgggtcttcatctaaaacaatattaactaatctttcattagcttcttctatttccgattttagcgttctagcttcttttgccaaatcatcatacatattttgcagacgagtaagattgtcacccgttaattttttctggcgttcaacgttatcattatatattttaatttgttggataatactatcttttttaacgtcaagcacttggttttgtgaatttaattcacgtattagtgctttattaagcttatccatttcagctaatgttcctacctcaagcaggtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcaaaaacgttcggtttttgtcctcttttgatatagtactttttctcatcatattccatccacagttcaactaaaagttctttcttatttgtgctgtttattaattgacctttctttacatcacgaaatggcttgccaaaaagcccaaatgtgatggcttctaacatagtagacttaccaccgccatttcgtccagtaataagagttttttgaaccttatctaattgaatgtcaataggatttccacctactgacattatattttgatacctaactcggtttagtttaaaattcttcacaaaagattccttttaatgtatcttttagaccattctatcatatcatcataatctaaaaagtattcatcaaattcagccatgcaaacaacgccttgtgctgtttttgatgtaatataaattattccaacatatctagaatcttcttcggtataatcaatgtttgctatgaattcatcattaatgtcaaatgtcgaaaacttcacagtatgcatccttaatacaagatacggccatatctcgtaatgatttaggtgtgtcattatctaaaatgttgaagttaaaggatacagcccagtcagtgcagaccgtaacctttttaatacaattatcttcaacctctagcggttcaaaccaatattcaataatttctttatgcccaatatcatcttttacttcgcattcaaaatgctgactcatcataacatttttaaattcatcaaaagtcattgtgttgcctctacatataactgatttgcatattgaataagtgcttcacggtcagaatcagtgatgtctggaattgcattaatgtattcttccatcaacgtctgaagagattgaacttcaacctcttcgctgtcatctgactcgacagagttatcaatctttgacacaactcgtaacgaatgcacaactttctctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcacctgcagttagtgtccatggtgtcccaatatatctgacgtttgcagcctcagaaatagtatggaagtgaccagaccacacttctttataagtcttaaggaaatcaggttcaagaccgtgagatttcattcctttataaaaataaaatccattcagttcccagtgaccaacacaaaaagaagcagatgaagttttgatatgctcaagaatttcaccagtattttcttcacacatccaaggaattaaatcaattaaacatccgtcaaaatctactgtagtaggcttatcatatactttaacattaggatatttagccaaaagctcagtagaggcatttggagttaaagtatttttaaagtgcatatcatggtttcctacaatagtatgtagggtaataccagcatcatcaagcatttgaactatttcacgggcgaactccatagttttgtgtgtgattgcttttcgcacatcaaaaatatcaccgtattgaatccaggtagtaattccatttttcttagaatattctattgcttgtttaattccatccaactgaatggattgaacccactcatcatcggctttaacgcctaaatgccaatcacctaaatttaaaattttcatatatcaagaaccgtcattgaaatgcaaaataaaattattgaaataaacccatctggcgtgctaaagaacccaatccaacatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcgcgttcacggtcataaagagttcggtcagatgacagttctttaatacgttcaaatgttgattccatgtcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcgtgaaaatcaaacatctgataaaaacctttccatgtagtcgtacgaccaatccaacggttgacattcatgttaatttcagaaacatctttccagtaggttgaccgaaccttcgcaatatccataggaggctgaaagttatatacggtcggcgcttcttcaatatcatcaaacagagaaacagtttctggataccattctttcatcagaactttattaaaatcaccattatcagaatggctaaaaataacatcagctcgacgaacagtttcttctaatcccaaatttcgacgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcgtattcttttgccaataaaaccggaattgaaaatgatttataatcatgcgcacagttacgagtaaatgatttatctttggcataaaccaaagttacttcatgaccatttttaataaaccaatcacgttgctcaagagaaaatttagttacaccgcaaccttcaagacctcgagccataaaaatacatactttcatttaatatcctcattgttttggtttattttaccaaaaatttataaagcaatataggagccgaagctcctatccgcataatacgccatacaaaggctcattagaacttctaaattttatgcgcttatatgttatagttccttctgctttagctttatcatgagactttttaaagcgtctcatcatttcctctttagaggaacgaattttattataatctatttcagaagtctgggtgttcatctttcacagttgccaccattttttgacttgataagaatcaacccacactttcatattagggtctgctcttacaataggaggattaacttctttaattgaactatcatggtattctttttcagaaattttcacacaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgtttcagaatatcccgacttttcttgatagcatattcgtattgagcaaaattattgttttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgatacctgtaatttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacggctgtcatagacattgtgaacgaagtaactgtatttctttgcaacttccttacgttcttttttaatacgttggacgaatgcattaaaacaagcttgagttatatatgcatgcgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaaacagtatgcttggaacactttttccatcatctttttaaattcatgaatatctatgtaatgactagttaaatcagcatgatataaaaagtctaaaaacttttcatgtgtactaacatattcactttcatttaattcagaaacatggctttcccaatatccaacaccagtcttatttgggaaaaatgaaattttcatgtatttgtcaacatagaaaatgccataattttcaatagtaatagaaatattaataaatttcatacattcatcaacttagccgcttcaagagctgcatctagtgaatcaaattgatcaacatattcaatcaattcgccataattagcatataaccaccattggctaaattcatactcaaggatgaatccgtttccttcaatttgagttaaaccaatgccatttgtatttacttcatacccagcaagacgtaaatcgttaataagagcttcgttcataattataccttagtaattttcaggtctgcaaattttttcttgcgttgatttttcatgcgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcaaagaaactactttatcatatgcgtaagaattaatgacgtttttaatttgaatagtcatacattatcctcaattacgttaaaattttattatccaaaaagggccgaagcccttagctaaactttttggcacccttccagccttcgtacatcattgcgactgacaatgacaaagctccttcacatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattgccattttcatcaataaatttaatccagtcatttactgaccacttagttgtatcgccttttggagtagcatttaaagtatatagcccttgcttaaaaagcattcgtttgatattcatattttcctcagctgtaacgataacactcgtttgatttgcgtttagcaactcgttgagaaatattataatcaaaatcatcgtcaatgtaaactgattttttcaactttcttacttcaccacgtaattggcggttcaattcattcttaacctctgaatcaacacctcgcatacgtcgccatttatctgagcgaaaaatgttttcaaccatatctttatgacttacaccgtctggagctttacgctttccgaaatagtcataatcacgcacttttaagtctttacgacgatacgttttacccatggagtttaatttccttagcaactgaactaaatgtagcacgatcgcaaatcatgcgtttatgtaacttgagtataatatagcaaacttcaaaactatttacatgagtaacacgaacagcattaccattaatgagataatactgtccctttttaatttctttatcaactacaaccatatcaattcctcaaaggtaattcatatgttaataataccacggtttgaacttgttgtaaacaactttgtgaaaaatattttagggaatgataagaaaggaacgatagcttagaatggtaatatacagaatgtgagaaagaaaggcccagagggcccgtcttaatcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagtggacgatcatactcaatcttaccgttatttgtaagaactttatagaaagtaaaaggagcattgagctcctttagaagttttgtaactgattgacatccaggacaacgacctacttcatctggaattccatagacttcaatcttattctttaagttcgagttttgttccacgagaaataattccttggtaagcccaataaggaggattaacagaatcctcgccagagttttcttcaggaaaataaacctggataacaaatccagatgcatcaaaggtaaaataaaccgtaggcagttcacctaacaattcggcacgagcattaatttcttcgagatctcgttcacgtccagcccaaaaactaggatttagactacattcgtaaaaataatagtcattaccgaacatatcaaaacccttccaactctctaccacataccgctcaaaactaatcataattaagcctttttatcaagaacagaattcagcttgttagtaattttatccagacgctcattgaactcgctagaagataaacccttttctggagaaatcaaactaatcacgaaaaatatagcaataaaaggaataaggaaaatagctccaactgccataaacagaaagaatgttacagttgtaagaaaatcagctaaacctttacgaaatttatacatattttacccttaattgattaaccaagcattgataagcactaaactatactgcgaataaaattctggaccaaaatgaaaaatcatatcatttatagtatccataatgtaattcaatttaatcatgtgtccacaccccatcggtatttgaccaaagccgctgattatctgatcctctccacagctttttggtcggaagatttttctcatacttcccatcaataataacatcaacatatttaagcatttctagttgtttaatatcttcaaacttatatcctgtccacaaccaaatgcttttatttggataaagattttttactgtttgaacaatgcaatgaataacatctcgattatcaggatagagagggtctcctccagttatagttaatccttctatataatcattattcaaacattcaattaattgttctagtgtttcaccagtgaatggaataccatttctagcattccatgttgatttattataacacccttcgcatttatgcaaacaacctgtaacgaaaagaacgaccctgcaaccagggccattcacaaaatcgcaaggataaaatctatcataattcattgatgcttaaccctatgcatgatttctttatttttgccgagattaaatccgcgttcgttcggatttcccaaataaccacatgttcttcttattgtattcatctttttaggatcagtttctccacaaatagaacaaacaaatccgttttcagtaggagtcatttcatgggtacttccgcatgtaaaacatttatccactggcatattaacaccaaaataatctaaatgttgtgcagcataatcccatacggcctcaagacctttcaagttatttttcatatcaggaagttcaacataagaaatgtgaccacctgtcgcaatgaaatgatatggcgcttcacgagaaatcttttcaaacggagtaatattttcttctactgagacatggaaactgttagtgtaccagcctttatcggtaacatcttttacacttccatatttttctgtatcgagtttacagaagcgataacaaaggttttcagcaggagtcgaatataaactaaaagcaaatccggttctttcagtccactgtttaagatgagcattcattttagttaaaatttctcgtccaatatcacgaccgacaagaatattcaattcgtgaataccaatgtatcctaaagacactgaacttctaccgtttttaaataactcaattatatcgtcatcaggtttaagacgaaccccaaatgcaccttcttggtaaagaataggagcaacagtagctttaactccttttaaggaactaattctacacatcaaagcttcaaaacataaatccattcgttcattgaacaattcaacaaatttctgttcattgaactgtgttccaatataagaatctaatgcgatgcgaggaagattcagtgttacaacaccaagattattacgtccatcaagaatttcattaccagtcgaatctttccatacgcccaagaaactacggcaacccattggagaaacaggaacagatgaaccagtgatagctttattgttcttagctgaaataatatcaggatacatccttttgcttgcacactctagagcaagctgcttaatatcatagttcggatcgtctttataaagattaacaccttcttcaacgaacataacaagcttagggaaaataggagttatcccatcacgaccgagacctttaatacgatttttcagaattgctttctgaatcattcgttcagtccagtcagttcctgtaccaaatgtaattgttacaaaaggtgtttgtccgtttgaactaaagagagtatttacttcatattcataagcttggaatgcatcgtatacatctttttctgttttagattgagcataattcaacgcatcagcgatttgccatttttctgcatcctcaatatgttttgcataggtgcgtttaacataaggagaaagtactttatcgacattagcaaatgtagttccgccatattggtgagaagcaacctgtgcagtaatttgtgccataattgcagtagcaacaccgattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaactgtgttttggtgtcagattcattatattcaaatcctctttgaagcatctcggccatcatttcctcttttcctaaacgagaaaattcctttgatttatctccaacaaagttagggtgaatattattttgggtgtaatcggattttaaataagtaagtaaattttctaaccattcaagataatcaacaccttgtccctttaagccagaacgattaaatttgtgcttcatttgaccttctgcagcattgcagagattacaaagcaatccacgtacctttcctgcttttggtccatttaattcatggtcatggtcgaggtgattagcttgaacatcaggatttagttctcgttggcaaattaagcatttaccgttttgtgcattataaaatttttgtttttcttctttgtataatttgccagtcaataacataataaaacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgtcctgtcagaaaaagaattttgagttttttcaagtattgtaaaacatttgatgcaatcgcttatattgccgaatcttttggtcagaaaaagaaatttgagtttcaagccattcaatgtactctgcggcagcttgcatcaggttaccttcatagccatcgttattttcttgtgcagctaatttagctaatgcgtatgaaatacgttcaccttgaaaagctgctttaggcttctgaacatcttggctagttctctctacaacttcttcaatttcgccattttcaacggattcagtattccacaaacaccagtatgtaattggcttatcatagatgttaataatctttccgtcggaaagttcaatttcaataattccagtatcaggttctatatcatcttcgcattcttttgcaagttcacgaactttaaagacagtacctgcactaagttccggccagtaattacatagccctgtatcaacacgattaattctaaaccacttatctactgtaatcatgtcccatctccatatcaattaagtcatttatcgttggttcattatatactgtttcttcatcagtgtaaaccggttcttccggctctggctctacagtttcccatctagccgcccaccaaggtttaaccccgaagcttattaagttcttcataatcaatccaggattctaatcctgatggcaaatcagattcaatttcccaaagaagctcttcaattttctgaagacgatctagttcttcggctggaatagtaaccattgacggagttcttgatacattaatatcgtaaatcatatttaccccaatttaaccatacaatcgccgtatttccacttagaaatagacttttcaccattagaataataaacttcgagtttagcacgattatttttaatttgaataaccttggctgtcatcaaagttccatacccataataaactgcaacttcatcacctacatataccgcgcttccgcggtaatcatgaatatagtcagttccttcgagcatcatttaaaatattctcgcagttggtcaaatccaccaatatgacttccatcaggagcaaatacctggggcattgtcaagccgatttgagtatcacgacctagtttcatcagaagctcagcgattttctcatcatcaaaaacacctttttccggcataatgttgataaattcaaacggctgtttcttcacggtcaaaagacgttttgcattatcgcaatacacacatttatggatgttgctatcataaccatatactttaaacatattattccttaattcctagtacttgtttaaaagtctcgtcgtaatcaagactttgacccgtttgttctttatgtttgtatataatatcacttacttctgatagcatatttttatatgaacgagttaaagcagatttaagcacgctgtatctatcaggaaatttaccatgttcattataataagctattgctaattcacggactgccttttcagcagtctccatatattctttacgcttggtcatttttaatccaaaatattattaggcattggttgaacactcgcaagttctttaaagaactcagtagagtcaggcaatttaaccatttccggagcatgcttactgaatttatgtttacattgacggcatttatattcaagctctggtttacgccagttaatcaactgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgcttttgcattaagagcttttaacaatttggtgtgttctgcaatttgggcttcaacttcaatcaaacgggcattgagatattcacgttcttcactcagattatcaaccttttctactttaggctcttttacaactgtcttatatgtattagggttcttcagtttaattagaatgcgtgaactgtataacattgaaccattatcttcggtttcgtcatacatttccactacgtccataatttttaacatcatgcggagtttataagacaacgaacgaatagttttgttgtgcttattaatttctttagctgtcatggtgccaagattacgtgagtaataataaggaacctggatattaattaatactgatgaaccacctggcttgtgtgttacttcatcagcaataacccagtccttaacatgaactgtatttgtacggtcatcgcccgcggtaaatagtttgcgagcatgcttaaaaagcatattcacttggtcattgaattgacaagcaaatttatcagcaaatttagtttcaggaatggtagaaaaccaatcagccaaatgagtctttttaacatcattaacaatagtaaattcaaccaaatcggttatagatgtctcagatttaatgaagctcggcttcataaagtttttaatgttctcatgagctacagtagaagataacatacgagaacgtttaaaccattcaagcaaattgcctaacgaatgagaatacgcattttgtgtatctttacaaatatggttttcccatccaatatagtctaaaaaatcacgaagaatattattgattactgctctgtgtcctatctgataattacgatgtttagtaataagactgtcaaaataatcaatataatgtttacgagttttcatgttcttctcacttggttaatgatttatactccgagccatccttggctttaaattacttaattaactgtaaagcttgttcaagacgatccaggcgattaacagattcttcccaaatccttttagcctgctcatattctttctgcgctttattagaaatttctagaacttctttataagctttttctagtgcaataacttctggacgaatttctactggttcaggcgaatcgtcaagacattccattagttcctcaagggtagtttcttctttaggagtattcacaatttcatcacatttttgttggtaaatttctttatcagtcggtgagtacgcacactttacttcacggagactaactacaattttatatccttcccaaccgcatatattcttaaaaggataagtatgaatattttctactgtttccatacaaagtaatgcggtctctaactgacgagttatatcgctagcaattgagaaaaatttattaatgttcttttgattagcttctggtgtaaaaaattcataattcacaaaaatagctgctttatttttatcaagctcatattcttttatgataatcatatcagaagcccaaggatggatttgacgataatcaccatagcataatttagaagctgattttagaatttgcttcttgaaaagtctaaaattactaatccaacgacgagtaaaaatattctcagggtcttctttattattaagatgataagaattaacatcaccgaaccaactgtatcctactacatctttggttcgtttaatttctttcccaaaattactaagaatatcttgattaaccaaatatgaaagaagacgagactctttaaaggttttcttgataacatctttatctacacggctagaaattttacgaatttcatgaataaatttagtagaagaaacaatacttgcatcaacactattgagccattgattgataatagaaagaacgctattttggacaaacatcggtatagctttatcatcaataacgctattgaatgatttgatatattcgttacgagtcataataatctcctcagtagaaagtaagaacattataccacatccttgtggcaaagtaaactagttcagtgcatttagtgcattgttcagtttagaacgttgctttgtcagattttgaacccttgactgagcttgttctaacgccttttcagcttctagcatttcattggtcgctttaacgagttcatcatctactgccttaagagacttttcaatcgcatcagcgtgccatttttctacaggtttaaaatttgaattttcagtaggaagaaaactcactttattaagtttacatgcatctatgttacttgaactgtacatccaacatttaggatcgtttgataagtaattggataaatttaaatttaaggtatcttgcacttcctgctttttctcttgaacaatttcatcctttctcaaaaattcatatttaaatgaaacgatcatatcaagttcatatgttgttgtatgttcccaatttcgctcaaaacgaggtaaaatcttagattgaacagcagcaacaacatccatatacttaaatgcttctgtcagctgtgatttaagacattcacaaattgaaagagaatttttagtattaggcttaaagctaattcgtgcagttctattattttcttttaacggtcttacttccatctgaagagtataaccatcaaatttaaggttctttaagttaatatcagagccttttaatcgactagcagtagacaaaatttgctttaattgtttacggaatagagcaataaatctccattcaatacgataatgatttggattgaaaaatccagatgataaatcgaccttactttgaccaacgccttgaacaatcaaaggatttttataatcaatagttttacagaaatcggtgagctgttcacgagcagtcatttgtgtaatataccctgctttactaaaattacgcacccattcactgctattcgtatacttaaagtgatgaataacacgattaactttattagggtctaaattattttcacacaaaaatgtcataacatcacgagtatagctggcattacgaaccatatcttcaatttgagaacgagttttcatggtgttccttaagatttaagtaaatcaacgattttaattaatttttcacgctcagatttagctttactactcaatccagatagtctgaaaatttcatcatcatattgctgaatagaaatatttaactcttcaatctgcttattaaaataagcaatttgttcagaatgtttttcattactgcgaactggtacaggttttgtaggtaatttagttgaactggattcatctgggcgataaattaaaatgcaatttgaaccaatcggacatttagcaccagacacatattctaatgttccggcttcttttaaaacttcaaaagctaaacagagatgatgccccatattaacataatctgtagagcgagctctgatgtaataatcatctccacgagtactaaatttaaagcatttaaggtcttctgtattattggtcttaaaaatcatttgtttatctagacctttagctaatcgagcgcctaatgctaataatcgtcgttgattttcccacaaatccgcaatcatttggtcaaatgataatttcggcattagtcgaccataaaggtcatatcctttattataattgcgaaggatttcactcgcattaatacgagacaacgctccaattttattaagggctttcatgatgcgattagataaacccattccagatccgtttgttcgttgcaaatgtttatctaatccaaacccaatatcaactttaaatttatctaaaatttcagcatgaacatctctgtcaataacattcaaatccaaagttgggttaaatctatgaaaaaatttatctggctctccacgacgaagtacagtccattcatttaattttttattaactaaagatttaattactgcattgacattattaattactactgacatattttcctcactcaattttcaattttactaaatatacagaataagatggaacagactatataagcaccacacacacagattgaactaataccattccaaagaaccaaacaatattatcaaacaatgtctgttttacgtcgaaaggacgtaaacttacagtaatattatcacctttttctattgaagaatacatctctggggaaatatattcactaaatctataaccgtctttgagttcatatacagcaataaacgataaactagacccctttccttgagttcctgtaagggtattaactacagtaacatcataatctttataatgcatataatcattaatagcataataaccatatgcaactactacacataaacagcatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttgtaagtttcaatacgctctgaaatgagagtgtatcgttcatttactgattctttcataaaatcaggaatttcacgagaagctttaatctcatcaaatttatcaataacagcttgctcttcagcaattaagttatcatacatcaaaatatctttcttgatgaactcaatatcttcttgagttacacgagataatttagatgctttatcctttttgtactgttcgttagtatcacgagaccagtgtaatgtacgatttttattcgtattcttgtaaatttctacaataccaatctcatcgataataacgatccaattccaacgagatttgtaaatttgtcctccgtcaaccgtgatttcacctccgattgagatgtcattaaagaacttactttgtgcttcagatttaaatttaccatcgttgtaatttaccaggttgaaaatatctttagcgttcattttgtgttcctccgtagttgatagttgtatagtaccacagaggaacagtcttgtaaaccactaaaagaaacttctttcacaattttttccactgaaccatgcgcttaccgctttcttagtctcaggagcagtgttatccataaaccattcaaaggcagtctttttatgattctggagggcttctcgggctttaatctgctcacggtctattaacactaacatatgagcctttcttgtcaccatgggcttcttatgattttttgaatactcccagtcatttgtccatcgcattgtcgttgcgaacttaaatactgcttctttaattttagtttcgtaaatttcacgagcctttgagtataacatcattacctccattcaccagtttaattctagtcatctttttaatggcagtccatataatctatttctgaactgcctttttgtcatagaagtcctcttatgaatttatttcagaagagtaacctcagcgatttcttgccaaccgtttttgtcggtcataataaagtcagcaagataaagtgcagtacgcagtgaaacattgcgtaaacggttaacattgactttcatccatgataatgctttataagtttcttcatcagaaagaccgcgcttttgcatcatgtcagttgaaagaataacatcttcaaccctgaccataatttcttcattagtgtgaacacccaaatccaaataaaccgagcgggacactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagatgcggtgctccagcagactttacgggtctctccagtgtccagagcagctttcagaagattaagaatgtccatatcagagaaaacatccacatcatcaatcaaaaggacagaattctcttcacgattattccaaagttgttcataaagaccgataccggagattttaccgttaatgcttttatattcaatgtatccattatcatttgctttattcaaagctttatctaaagaatacgttttaccaatacccgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcacctaagagctcaaaagttccagagatttctttaccgaagtagatacccttattgatagttacagttttcattttattctccaatctcacatttgttttgatagggtaatagtatcacactactacccttctgtaaacaatttattttaacgttcgccaaatttttactgcttcacggcgagatacttctacagctccaagttctacagctttttggcgtcggcgagcgtgtaagtcataatgtttaatgcgtttatcttgaaaccaagaacgtttcattcctattgcttctgccatttcatgaagctcttcaatatctccatcagtgaacatatgacaatttttagttggatgaccgcgaagtttccatccatgattcattaaaacatctacgtaaactgtcattgattcttctccaaataagtttcgataattttctgagcgagataaactgcattatcttcagttgcatcttctaagaaactttcaaaacactctgaaatttcttctgtgtcaatcaacttttttacttcaattggtgtaattttcattttgtttttccgtttaagtgtttgttttgatagttgtatagtaccataaagctttatgcttgtaaacaattttgtgaaaaatttttgaaataaaaaagggagcccgaaggctccctatcatttataataacttcggtggttttcaagataaaccctctcaaggaagtcatcccaaaaacccatgtctactttttgctgcataccgttcttagaagcttcagtagatgctgcttctacttgatcgaccacatcttccaaaaactcttgaaccgttttaaatggatgtttacccaacttcacgtcgagaataaatggagcatcttggagtggataaaccaagtcaccagttttgtaaatttccaatagttggagtccaccacggcaagcatgactcagagctttccagtcaataccttcattggcttcggccttacgagcacgttcaccgtattcagcatctaatttgttcagtgactgcttaagctcaataagagaaagcgttgtctgatatttacgacccaacactgtgtagaacgtctgtgggcctgttttctcatgattatggaacacccattcacagaattcgttttctggaagacgatgcttaatatcttcaactttagtacgacgctgcttaatagaaccatcttcttggtaatcaacccattgctcagggatttgattaactactttcaatacatcacgtaatgcagccaaacgagaacccttaacgccgtatttagaagcttgcttacggacatatcctaaataggatttcatgttagtcgtataaaaacgagaacggttgtcttgaataaacttccacacatcaggcaaatcagatttaaccactagttcaggtggagtgtgaagcatatctaacgctacagtttcaccatctgctgctaatttaaagaaatatttaagactgtatagttcatggtcaatatcatctttagtgtttttagatgatgtgttgttagtgtttttactcatgtgctctttaacatttccgataagaatatcacgagcaggaggaacaaagatttctttaaaatctacatcagattctggggtagaagttccataaagatgactaccaaaatagcttttcattactgttttcatcattcagccttatattcaataacaggacatactttagctttacgagcttttaaaaattcaacgataatcgatttcttgggttgaataggaggtaaacctttatacgccctatcaatattttctacgtgtaaagcataatcctttttccatttataatctttatatttttcacgcagttgtgcaggaataacaaatgaaccgataataagtaaaacaagcaaaatggcaagtataaatgctgatggaataagagtccataaactaccaaaaataagccatttctgtatgatttctgcgcagatgatagttagacctacgagtatagtacatccgaaaaaagaaacgaaaaatgtagggataacaatagaccaaaagtatgcgcacagcgtcttaggtcgttgccattcatcgttaaacaatttgaataatttatagtgccaagagttttcattaataatcataattatcctttcattgaaggtgtaacagttgttaaatacttaatcatagcttcagcttctgattttgataatgaaatttcttcattgttttgacgaatagaaataaaatccggatgacggtcaccaccagcttttaaaacacacatataagtatcagtttcatcttcaatatctgaaatgattgaagcagttccacatgaatgcggtttttgataaatcaatacagcttttcttccgccatttgactgttcataaacttttaatacatcaaacaaatcacttcttttatcaatagctaaaatgttattttcatcttcaatgttaaatccttcggatacttcataaagtgtcacccataaatcgccaatatcaataacagcgttcacttttccatgactttcaagagcatgacaaattttcttgatttcgtcataactcattttaataatatcatctccttgaataagaaagatgtcatttttaaattcaacacgaattaaaccacttccacttgaaataaacatatttcctcactttgaaatcatagttggaatgacagaatcgagataagtctttagcgcaatagcttcgtctttggtaaatgtgacaatatacgatcgaaaatcatcaatttgacgaatagttaagacatcaccatcttcatagcattttgatacgtttaaaacagtttcatcattctgattgcaagcgttagtaataatagcattgcaatttttgagccattttaaactatgttttctttcattagaataataaaaatatttaatcttatctataaaactatcccaatggataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgtgtcaaacgatacatattatttactttttctatagctaattcaccaaaaagcggactaacttctaatactaatcgtttcatattgattctcttcgactcacccacaattacatactcctttgaataatatcaataatgttgttcaccagattataagtaaacattggataattatattgaatcatcacatacacaacaaacaaaactttcattctcttctccttggcagttgacaagattactatatcataatcttgtcaacttgtaaaccattaaatgacgttttcaataaaattctgaagctttgtgtgagcatcaaccatgattttcatttcttcctttgcgaaagctgtacctctttcccgagcagaatactcatagtcagaaactgcattagcatattcttcaattagcttcattaaaaacatctgcttttcagttttcattattccacctaatcatttcaagatattgaactaacttagctttggatttatccaaatcctttttagctgcttctataccgtcgtatgaatatccttcacaatgctcaactgctaattggtatgaatctatttcaatatcacgtgctaatttaatgattttttcaaactgttcacgtgttagcataattaaactctcgtattatgatcgataatttcatcaagaaacatatctaacgcttctaaagcattatcaactttagcttcaaatttttcaatacctttatttgcaatgcctgccgaaaaccaagcaaagtcactaagttcctcatctgctttgcgaattaaagctaccaattctttaattttatctgcttgttcaattctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattaagtgcttcaattttcatgatgttctcctctttatccgatagttgtatagtaccacagctcaaacggaaagtaaaccggtaaaatgaaaaaagtctcccgaaggagactaatgttattcgagggaaagaagatacttactttggtaaaacattccagtaatatcatctatcgtgctttggatggctggaggcatttctttataaatgctgttagattggtctagtatgcgatcaatcattttaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttattttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagcacagtaagattgcgaagttgcttttcagttaattgtagcatatatacccctttagttagataaacctatttataacttttgcactaaccgagctttttagttaattcattccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcgcgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcatattcacataagctattaattcgttttctttcttatcaaaccgatcagcaaattcttcttgctgttcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattaacagcgagttcaattaaattatcaagctcacgtaacacttcatactgtaactcaaaactattcatttcggtttaccttctttaacgaaatctggataaggataaaatcccgaataaaatccttcacctttatgattgatgcatcctttattagaacaatagcaccaataatcgaaatcacaagccatttcatcgttgcataaagcaaaaacaactggccatttacacttttcacaatgggcatttttaagaatactagtttggctcataaccatgtaacctttaagcagtattcttctacatgctgtttacgacctttcttatcaataaaggtatattcaacgaatgttccaatgtagtctttatctacatcatgcggactattaattggacatttagtacggcaaatgcgttcccattgacgaataattactgccttattctttgggtcatatggatgtggataatgtatattcataataacggttcccaatcaacaatcacaatttctaatttagaggaatatgtatctaaaatcccctcaataatatcccagttccctttacctatgcctgcaccaatcctaggcatatagattgtaggtttaatcagtttattttcaccaaactcatttaattctaacatacaattcattaaagcggaatactcaaaatttggccctggttgaaattgagtataaaggttgaagcaatacgctttatgagtcctaaagtatttttcatagactgagtaagaaccgagtttagttacatcaccccattcagtctgtaatttatcagcttccaaaattttagggaaagctttggttaattgacccgctacgcctgaacccatagtatgaaaacaattgcatccatgcgcaatatttttaccttcagcgaaaagggcgacaatatcgcccttgatatattttacaatcatctagtactcaatcctcgattataagaatctaccaaacggtcaaccattgaatgacaagcggctttatctttctcctccgcaactgaacattctaaggtattccactttttagcatatcgttttaataatgtatcgtttttgtatctgcttgatttatctctttctccgtctttatatgcatatattaatttctgcgcaaattcagcttggcatgctttatttttcccacaataatctgccgcagtgcgatttacatattctctaatttcagtatatgatgtatctgctaacgcagaagcagaaaatgaaattaatcctatacataaaaccaaaattttagtcatttactatttccaaaagtttattatttttaaggtaattagccttttctaggacttcagaagcatatttagaaccagctttaacattccatcccgaattataagaggatattgcttttcttatatcgcccttatgtatatttaaccaataagaaagttcaatgtacgcccaggaagctgaattggatcgtttattcaacattctttttatttcagcatcggtcatattataaccaagttccttaactcttgctcgcatagtaggcaaataattttggaacattccataagcgtgatgctttggtttagattttaaattaactccgccagagctttcttgccataaaatagcagccattatatgacctaatccgctcttgtggatatttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctgcattgaagtgacgggtttttgaacttctcattaggcttacaaaccgtaaatccaagccaaagatttccatctgtgatttctaaacgtccaggacgatattcaaccccatcaataaaatcctcgtcaatgtcaggacgcggaggcatactcaggaattcattaacttctaaaacatggtcttttattttatggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaaatgacgacgaagcttatttcgacggataaaaacttctgtattgatagtcatgttgttctcctcttaactgatagaaaaattataccacagtcaagaggaaaagtaaacagttattctttaaatctaatcaatttattcatagactttgaaacttctgcacgaacctcatgtagatttttgagctgttcaagacgctgcgtatagtaagcaatttcatcttcttcgagacagtcctgtgaatcttctttaagataccgtgcatagtcctggaaagcgttacggactacttcctggaagtcatcaagactttgaattttcttaggagcagcagacacacgacgaggggcagtataatactcataaccaaaccctgcgcttaattgagccattagtatttttcctctggttggaacacagcacgacaagcccacatactggcttctttgagtttcgttttagcaatagctaactgatcgaggctttcagcataattcttcgcgagttcaaagtcttcgcaattatctagtgcttcccagaattcatcatataaagcatcaaagataagtcctaaacgaacttcagcgtctttaatagcatttactttaccgattttttcgtcggtatgtggcttataacctttaatatcttcaatcatatttgacttcctcaccagtacataaatcgtattcaactaaacgaataggttcatgaatgccatatccctgaacaaaaatttctgtcgtaggataaattccactaatatcacccatattccacgcttcattaaattgctgttcgcctgaattactaaaccactcggcgaaagcatttagcacatcttcagaaccttcaataattatctttgccattacaaactctcggtgaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattagaaaataaatttatccaagattgttctttaattaaaaatggctcagaatcatatgccattaaactctgtgtgattagtcctttaaaaggcccatcaataaattccatggtaaaatatggaattttattcattagccgtgcattaggagccgtgcacaaaactctgcatcctttgaatacgcctttttgtaatttgtattgcttgggataaaattcgctcaaaatgttattttttgccaaaatttcaaaatgattcaccaatttatttttaatagtttttggcgaaaaataaagatattcgaaaagctgagtgtctgtcatcattgcattccgattacgaaaaactgtggacgagtaataccaccaatgcaacatttaatattacagcagcagtgtacagtgtcaatatggacactataaatcttatccatatcaggagatttgacaggctcatcaattatatacaaaattcgcgaaagtgataaacctctgaacttgcttcctttattaccaataaaactgcgcacagaatcagtaaataaacgaaaacgtatatcatcattagaataacgcgaaaattcctttttaatattatctgcggaaattttagcgtaagctgaagtattagaaagaacaataactgttccaccgtcatacaaccaattagcggcaaaattagttactgcagttgatttaccagattgacgcccaccatctagtcgaagtgtacaatactgtttaagtaagtcttcaaatggcgggatatattcgtttttacaaatttcttctactctagcatcagaatggtgtgtaaaagcattcatcagggatagataaggaccagttaaaaatgttctcatttttgttctctctaggtttgggccattccatggcgcatgaattgtctatttctgtatttacccattaccgcacttgggctcgaccttattacaggttggcgggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaagtgtttgattataccatctacttttagctaagttaactgctgcttcatcccagcgtttttgttgaagcatacgcaaagagttagtgaatccagctacgccagtttctcccatttggaaaaccatattaattaatgcacagcgacgaacagcatcaagagaatcataaactggttttaatttagcatttctcaaaattccacgaacagcagcatcaacatcctgattaaagagtttttcagcctcatcttttgtaattacaccattgcaattacgcccaatagctttatctaattcagatttagcaacacttaatgatggacttttagtaagcaaatgaccaatgccaatagtgtaatagccttctgtatctttatagattttaagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaggtcttctagaaggtctggattataattgctaaaaccggtctcttctaagcattctctttttgcagcttccagtgcattcaaatcagaactttctacgcggccctttggaatatcccagcgatgtgccatcattccaggcttacgagaaccagtaacccgacccataaataaatctttatcttctgtcataaagataataccagctgatagtgttttcattttaatttcctgcattcagtgataaagttatttaaattttgagtatatttcttttcatcaaaaatcttttgttgtctgcgtaaacgccatggcatttcaatgaacatacgccatattcctgataatactgctgctgtaaaaatattaacaagtatagttaaaagaacccaatctcctattctgtccattggattttttataaaaaagtaaaatacgaacgatgatataggaagactaatgatataccacagaagaaccttcttatctgtgaaccaatcagcattcgttaacttagcgcgaccgttttgaatacatacgaacttatcatctgttacagtaaatggcttagctgcttgatatcccattctaaactccctaatcaacaaatttttcatatcttcggaacaaccattccagtcaactctatcaactgaaatgccatcgtccccatcatctaaatcataccagcgagtttttaaaatcatttaattttcctacaatcactcacaaactcttccattgattcttttcaatataagacatatagctattatattcctttaattgtattttgtaatccttttttctttgccaatttattttaaaattatcataatgaaaatataacatggtaccaaagaatgaaaataatgaaatcgctatagtaaaacgaagttcactccaaacctctgttataattactgtgccgtcgatatttaaaataaaacagtcaattaacaatccaataagactacccgcaagagctgtaaatactgatacagcaagaattaatagtgcctctggaaacgaatatttgactttatttagttttggcttttgcatcgtgattccttaacaaatttcataatttcatcaaattcatacatatctagcttaagctggtgttcctttttaatctttttacactgagctttccaatcacgtacacgtttacgataatgtcttccttgataccagtatcctacccaatttacgggtactaataaaagtggaactattaatggaagaattagcattaacacaagtatttcgccagaatcaatatcagtcataacatctaaaacacctccaataatcaatagaattacaaatgatatgagtataacaggacctattaacacatcagtagaaattatctgacgctttggttcatacttcacaggtttacttggaaggtatagtgatggttttgacatattctctacattccttaacaaatttttctagtaataaatcactttcaaaattgggattttctacaaatttatcaaaaagatcatcaacaatagttaagatattctttttactaagaatacgtttattttcatgcttcgtttcagaatcaactataagagtaaagaaatatttcttgccctgaaattttacagtagtatcaatataaaataaatttgacttttgtaaattacgtttaaaccatgcgtcacttaaactataaacaccgagataatcaaaatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatgcgtttaagagcatttagtaattggtctggaacatcaacctgtctttggaactcttcaaacattgaattgaaatcactttgcattttcattttcattcctatttactccaagtataaggggccgaaaccccttatcattatttcagagaattaatgtattcctgaacatcggcagaggtagtttcaaccccagaaatattaccgttaaaggtttcaactcgagcaagggtatcttcaatatcaaccttagtcagtgctgcaatttcaactacatcatcggcagtactaattccaagggcatttgctgcacgagtttcacggatatattccaatttaaccgcaagttcttgacgagcatcatctaactcaactactttcttggcgatttcaattcgcatttcagcataaccgtcagcattagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccatgagagtattatactccggatagtttgtaaactatttcaacatcgccttttgctgctttataaccttcagcccaagatacaaccgagtttttatccgaagattcaaattctggcattgggctttcgccaatgttcacgcagtatgtttcttcattttcgtcgaaccaaataattaaagtagtcatttatttctccgttttctgtatttgttttgataagtctataataacaccgtccttggcgtttgtacacaattatttcatattattgaaatattcttctgcgatttcatcgttatcatggtaaactttagaagacagtttaacataaccttcagcagtgaacatgttaatcacaacctttacagtataccactgaccatcttcattacccattactgcataggtttcaaacatcggatggtcaggaccgataactttaatatcattcactgtacgaccgaaatcttctgaaacacatttcataaagaagttgaacagttcgccgtaattatccatttcattctccaagttgtttttgtatcagtagttgatagttgtatagtaccatggaagaacagggatgtaaacagttttgtgaaaaaattttttaaaaagttttagggaattctagggcagggaggggcaattaaaagataggataatatattataaagggtagaaactaaatgatgtctagagaggcccggaaaggcctagataccaaaaagccctatcatttagatagggctttaaaattatttacctagtttagttattatggcttcggcagcagcttttagcttagatgcagtgttaatacgatttttaatttcagtatacgcatcgccaagaacatcaaggctatcagaataaacacttacactattgcgttcgctatttgaaatagaacctttagttttacgatcaaaatcggtgtacacgtcttgaagatcacgggctgccttctttgcatcatccaatgcatcaagagctttattcaaagcattaacgtattttttggtatcgaacatattcttagaaattttaacaggcgcacgttcaggagtagctaatgcagatttaggaacctgagcgccagatgccagtttcttagaaattttgaaaaatgctttattgaaattattttcttgactcatcgtaaaagaactgttatcgatgttatacatttcaatagctttagctttccacttaagaaaatcgccccggtcttttgggtccaagtggaagaatactttagtaagatctgcttcagatggtaattttgctgcttcggttaaaaattcggcataggttttcatttaaaatccttgaaataatttattggttattaattatttatcacgttgttatatgtaacagcattctccgagcgattcaaactaaaaagccccaacctttcggtcggggctaaaatgttatttgatttgtttagcagaccaaatgcggtctttaataattttttggatgtcttcaacatactcaagagagtgaacatgcgggttatctttgaaactataagcacgagctagcttttggccttcagttttgattactaaaagctctttaaggatagcttcatatttggagataattcctttaacaatatttttctcttgtgcgactttaggatctgctttaggagcaggtttacctgaagcctttgcaaaagcagctccagtagcaactaaacttttccaagccatactaactgcgttccctgtaaatccttcggctttcatatcacgagcaaattggaatcgtgattcatcggaagcatctttataggaatatttacccgcggcaatggcagcttttgcaacagcttgaatttcggtgctagatgcttcatttaacaccgcttcatttaaaaattgagcatatgatttcatcttatttcctgttttaattcgtggttttaatatacttatttatactaaaaagccccaacctttcggtcggggctaagccttgcggcaaccttgtcggggttccacctgctaaggcaagtgtttgtacgaaacgccgggattcgaacccggttattaagcagttgacgctactcaatatttttaaaaggccatatctcgaccatatccgaacgttccgtcaaaaacgctactcggcttacggcaaagatatttcctcgaatcgataattcggtgcgccgtttctgctgtgatataagggggcattaacaaaacataaagatttattaatgccagtccttaaacagggaacatcagtccgacgacttgccggtagcgacccggcttcttgtctggtcgaggcagtagggatcgaacctacgacccaggacttagaaggtccttgctcttccttctgagctatgcctcggatttggcggacgtgataggattcgaacctataaccaatcgcttaacaggcgatcgctctgccattgagctacacatccaaattggtggggagtgatggagtcgaaccacccgagtcgcaatgacaatggatttacagtccacaccgctacctctacgggataactcccctaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggacgtgataggatttgaacctatgagtcgccggagcgactgccggttttcaagaccagtgcattaaaccactctgccacgcctccagtctccgtggcaggatttgaacctacgacattctgctcccaaagcagacgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttggccattctcgcgctgggaataaaggactcgaacctttgcatcctggaatcaaaatccagtgccttaccaacttggctaattcccaattattaacaaaggctcttaagcaagaacccttgatgatagagggtattaatcagtgcgatatgagttaataataacaaataattcttaaagcatatttaccatttatgataatacgtatttacgatacattcaagacccaaaggattcttgaaaatatcatattcaagaggacctttttctgtttcaataaagaaatcaaaatttactgtattaaatttgcggtcttccttcactaatttaacttgagaagatgaacggtcaatgtaaaccttttcaacttcaaaacaggttaaaatgccataatcatcaatcaaggctttagctgcttcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaacacattttctgctgtagtcaataatccacatataaatccaacaaacattgaaaaactaaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttgtagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccgcttgatagaacatacggaacatttactcttgaataacatatagtcgaatgaattttttctctaggaactggattaggaacacgtaaagagcgctgaagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcctggtcctgcgtatcaagaatacgagacttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgagtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgtccttcgtcatcaaaaacaaacacacctttaattgggcttttaccattaagatagcaaaatgcttgttccataatcgtgattacttctaatttagttagatttaaattagtctcacgatcatagtcaattccttcaaactctttacgagttaagcaaggataatcggtgtttgctgcaaatactccccatgcataagccaatgcatccttaataggaccagcaagttggtatttaactgcagaataattgctcatgataaaatcagcagtagtatcttttccactacgctttacaccgcttaaaaagattagtttcatatgtttctcctcaaatttaattaagattataacacacaaaactgaagcattaaacttccgctataatttttccatctttttctacttgaaaatacgtataaggaatcgttgctgtacatactaaagccgggtctgaatcttctgtgtagctaaattctacttcagataggtcagaaacccaaggcttataaaaatttattgacatcacgatttcagttttgctattatctaaaatgtaaagcgtaatgtattcaggacctgttttttgggcagtattttcacctgtaagatagttgctagttcctagcatccattcatacattcctatccatgacttaagttcttcatcaactataaatctcacgatgagtggatcgtactcaaatgtagcacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataactgttggtggtataatgggtctaagtcccttccattcaattccatttagaacaaacaacagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccaggtatatatgccttaatcatttggtctgcgcccctaaatcctttcacttgactccaatcaatttttaatttcgttttattagtaatagtaggtgtatttgcatattgctttaaaagctcttctaggaattgctgacgagctttaggtggaatatagtgcaagttcaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcgcgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgatttctctttcttcagcaaattgctttcctgtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgtcagaattctaaattttattccacgcttttcagctaaagcttgcgctgctttccatttgtcggtattaacagaatatgtataaatttcattcataaatcttttcttcgctgcggttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgtcgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctggaggttctggcagtaattctaggtcatcttctgatactactgaaccgacaggtcctcctgctccagtaagaaaaactctcgttaaaaattatactaaaactatagttggaaattggagtcgttgggctaataaattaagaagctatgtgtatgagaggtcatagatgtcaggattaagttatgataaatgtgttactgctggtcatgaagcgtggcctccaacagttgtgaatgctacacaaagtaaagtattcactggaggaattgctgttctcgtagcaggtgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacatttgctgaaataaaacaaaacctcattgaatggcttaatggccaaaatgaatttttggattatgattttgaaggctcaagattaaacgttctgtgtgaccttttagcttataatacattgtacattcaacagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattactattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatacgttgatggagcagaatggattaactggacaagaaagtcaatggttcatgctggttctacatcgacaatttactacatgcgtgaaactattgatggaaatactgaattctattttggtgaaggtgaaatttctgttaatgcttctgaaggagctttgaccgctaattatatcggaggtcttaaacctactcagaactctacgattgttattgagtacatcagtactaatggtgctgacgcgaacggagcagtcggattttcatacgcagatacattaacaaatataactgtcatcaatattaatgaaaatccaaacgatgacccagattttgttggggcagatggcggcggtgatccagaagatattgagcgtatccgcgaattgggtactattaaacgcgaaacccagcaacgctgcgtaactgcgactgactatgatacattcgtttcagagagatttggttctattattcaagcagttcagactttcactgattctactaaacctggttatgcatttattgctgctaaacctaaatcaggtctgtatttaactactgtacagcgtgaagatattaaaaattatctcaaagactataatttagctcctattacgccatcaattatttctcctaattatctttttattaagactaatttaaaagtcacatatgctttaaataagctgcaagaatccgaacagtggctcgaaggtcaaataattgataaaattgatcgttattataccgaagacgtagaaatttttaattcatctttcgctaaatctaagatgttgacatatgtagatgatgcagatcattctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgacgttcgcatagtatcaacagaccgagattctaaaggaattggtaaagttattattggtccatttgcttctggcgatgttacagaaaatgaaaacattcagccatatacaggcaacgattttaacaaattagcaaattctgatggacgcgacaaatactatgttatcggtgaaataaattatccagctgatgtgatttattggaatatcgctaaaattaatttaacatctgaaaaatttgaagttcagaccatcgaattatattctgacccaaccgatgatgttatctttactcgcgacggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaaaacgaactcgggggaaaatctcccgagtaatcaatacagatggattaacttaggatatactgcaaataacagcttcttttttgatgatgctgacccattgacatcatacattatcagagtagctacagctgcgcaagattttgagcagtctgattggatttataccgaagagtttgaaacttttgctacaaatgcttatacatttcaaaacatgattgaaatgcaattagccaataaattcattcaggaaaaatttactcttaataattctgattatgttaattttaacaatgacactataatggctgcattgatgaatgaatcatttcaattcagcccatcgtatgttgatgtttcatcaataagtaattttattattggtgaaaatgagtatcatgaaatacaaggttctattcagcaagtatgtaaggatattaaccgagtttatttgatggaatcagaaggaattctatatctttttgagcgctatcaacctgtagttaaagtatccaatgataaaggacaaacctggaaagccgtaaagctcttcaatgaccgtgtaggatatcctttatctaagacagtatattaccaatctgcgaacacaacatacgttctaggatacgacaagattttctatggccgtaaattgactgacgttagatggtcagcagatgatgtcagattcagttcgcaggatataacatttgctaaacttggcgaccagttacatttaggatttgatgtagaaatctttgatacttatgcgactttaccagcgaatgtatatcgtatagctgaagccattacttgtacggatgattatatctatgttgttgccagagataaagttagatatataaaaacgagcaatgcacctatagattctgatccattatctccaacatattcggaaaggctatttgaatctgatacaatgactataactggaaatcctaaagcagtatgctataaaatggattctattggtgataaagtttttgctcttattatcggtgaagttgaaacattaaatgctaatcctagaacgtcaaaaataattgattctactgataaaggaatatatgttttaaatcatgacacaaaaacgtggaaaagagtttttggcaacactgaagaagaaagaagacgtattcaacctgggtatgcgaatatgtcaactgatggtaaattagtttctctatcttcgagtaattttaaatttttaaatgataacgttgttaatgaccctgaaactgtagcaaaatatcagttaatcggtgccgttaaatatgaatttcctcgtgaatggttagctgataagcattatcatatgatggcatttatagcagatgaaaagtctgattgggaaacttttacgcctcagccaatgaaatactacgcagaaccgttctttaattggtctaaaaaatctaacacacgctgttggataaacaactctaatagagctgtagtagtttatgctgatttaaaatacactaaagttatagaaaatattccggaaacatcaccagatagattagttcatgaatactgggatgatggtgattgtacgatagtaatgccaaatgttaaattcacgggatttaaaaaatatgcgtctgggatgcttttttataaatcttctggtgaaataatttcttattatgattttaactatcgtgtgagagatacagtagaaattatttggaagccgactggagtatttttaaaagcatttttacaaaaccaagagcatgagactccttggtcgccagaagaagagcatggattagctgaccctgatttaagaccattaattggcacaatgatgcctgattcttatttgttgcaggattcgaattttgaggcattttgtgaagcatatattcaatatctttctgacggatacggaactcagtataataatttacgaaatttaattcgtaatcagtatccacgagaagagcatgcgtgggaatatttgtggtcagagatatataaaagaaacatttatttaaatgctgacaaacgtgatgctgttgcaagattttttgaatcacgtagttatgatttttattctactaaaggaattgaagcatcatacaaatttctttttaaagttctttataatgaagaagttgaaattgaaattgaatctggagctggtactgaatatgatataatcgttcaatctgattctttgactgaggatttagtaggacaaacgatttatacagctacaggaagatgtaatgttacttatatagaaagaagttattctaatggtaaattgcaatggaccgtgactatacataatcttttggggcgtttaatagcagggcaagaagttaaagcagaaagacttcctagttttgaaggcgaaattattcgtggggttaaaggaaaggatttgcttcaaaataatatagactatattaatagaagtcgatcatattatgtaatgaaaattaaatccaatttaccttcttctcgttggaaatctgacgttattcgttttgttcatccagtaggatttggatttatagcaatcacgcttttaactatgtttattaatgtcggtttaactcttaaacacacagagacaataattaataaatataaaaactacaaatgggattctggattgcctactgaatatgctgatagagtagctaaattaactccaactggtgaaattgaacatgattcagtaacaggagaagcaatttatgaacctggcccaatggctggtgtaaaatatcctcttcctgatgactataatgctgaaaataataattcaatatttcaaggtcaattgccttctgaacgacgcaagttaatgagtcctctatttgacgcatctggaacaacatttgcacagtttagggatttagttaataaacgtctaaaagataatataggaaatccaagagaccctgaaaatccaacacaggttaaaatagatgaatgattcaagtgttatctatcgtgcgatagttacttcaaaatttagaacagaaaaaatgttgaatttttataattcaattgggagtggtccggataaaaacactatctttatcacatttggaagatcagaaccgtggtcatcaaatgaaaatgaggtgggctttgccccaccttatccaaccgattctgtattaggcgtaactgacatgtggacgcatatgatgggaacagtaaaagttcttccatcaatgcttgatgctgttattcctcgcagagattggggagatactagatatccggatccatacacatttagaattaacgatattgtagtgtgtaactcagctccttacaacgctactgaatcaggcgcaggctggttagtatatcgttgtttagatgttcctgataccggaatgtgttcaatagcatctttaactaataaggatgaatgcctcaaattaggcggaaaatggactccttctgttaggtcaatgactcctcctgaaggtcgaggagatgcggaaggaacaatcgaacctggagacggatatgtttgggaatatctttttgagattccgcccgatgtatctataaatagatgcacaaatgaatatatcgtagttccttggcctgaggaattaaaagaagacccaactagatgggggtatgaagataatctcacttggcagcaagatgattttgggttaatttatcgtgttaaagctaatacaattcgttttaaagcatatttagattcagtttattttcctgaagctgcattgccgggaaataaaggatttagacaaatatcaataatcacgaatcctcttgaagctaaagttcatccaaatgatccaaacgttaaagctgaaaaggattattatgatccagaagatttaatgaggcattcgggcgaaatgatttatatggaaaataggccacctattatcatggcaatggatcagacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcagcgtaaaatggcagtagcaaatggcactggagcagatggtcaaattatccatgctactggatattatcaaaagcactctatcgcggagtacgcaactccagtgaaagttggcactagacatgatattgatacctctactgtaggtgttaaagttattattgaaagaggagaacttggcgattgtgttgaattcattaactctaatggatcaatatcagttactaatcctttaacgattcaggctattgattcaattaaaggcgtttcaggtaatttagtagtaactagtccatatagtaaagttactttacgttgtatttcatctgataattctacgtcggtttggaattattctattgaaagtatgtttggtcaaaaggaatcaccggccgaaggtacatggaatatttctacatctgggtcagttgacattccattgtttcatcgtactgaatataacatggctaaattgttagttacatgccaatcagtagatggaagaaaaattaaaacggcagaaataaatattcttgtagatactgttaattcagcggtcatttcttctgaatatgctgtcatgcgggttggaaatgaaacagaagaagacgaaatcgctaatattgcatttagtattaaagaaaattatgtaacggcaactataagttcttcaactgtcggtatgagagcagcagttaaagttatcgctacgcagaaaatcggggtggctcaataatgaaacaaaatattaatatcggtaatgttgttgatgatggtaccggtgactacctgcgtaaaggtggtataaaaataaatgaaaactttgatgaactttattatgaacttggcgatggagatgttccatattcagccggtgcctggaaaacttataatgcttcatccggtcaaacattaaaagctaagtggggaaaatcatacgctattaatacctcttctggaagagtaactttacaacttcctaaaggaactgttaatgattataataaagtaattagagctagggatgtatttgcaacatggaacattaatccagttactttagtagctgcttctggggatacaattaaagggtcgtcatcgtcagttgaaattaatattcaatttagtgatttagagctcgtttattgtgctccaggacgttgggaatatgtcaaaaacaaacaaattgacaaaattattagttcagatattagtaatgtagcacgtaaagaatttttagtcgaagttcaaggacaaacagactttttagatgttttccgcggaactagctataatgttaataacatccgagtaaaacaccgcggtaatgaattatattatggcgatgtatttagtgaaaacagtgactttggctctcctggggaaaatgaaggagaattgattcctcttgatggatttaatattaggttaagacagccttgtaatattggtgacactgttcaaattgaaacatttatggatggtatatcacaatggagaagttcatatacaagacgccaaataaaagtattagattcaaaattaacgtcaaaaacttctttagaaggaagtatttacgttactgatttatcaacaatgaaatcaattccattctctgcatttggattaattcctggagaacctattaatcctaattctcttgaagttcgttttaatggaattttacaacaacaagctggaacagcaggatatcctctgtttttgtgtgaaggtgctaactcagatacgcaagcaggatgtatatctcttggtggtgaatggaaagaatctaacacagattattctatagaatatgaagatggaaaacctgtcagtcttttatttgatagaaaatttgaatcaggtgatataatcgttataacatggtttaataatgatttaggaactcttttagaaaaagatgacattattgaattaactgatgaccgttatgttagtaaaggatcatctactgaagttactggggatgtagccttaacagattttgataaaatcggttggccaaatgttgaaaaagttgattcttatactagaacgtataattcaatatcatctattttcgatagcatttatcctgtaggttcaatttatgaaaatgctataaacccaaataatccggtgacttatatggggtttggttcgtggaaattatttggtaaaggacaagttttagtaggatggaacgatgatgttacagatccaaactttgcattaaacaataatgatttagattctagcggaaatccttcacacactgccggtggaacagttggaacaacgtcagtaacgcttgaaaatgcaaatcttcctgcgactaaaactgacgaaagagttttaattgaagatgaaaatggatcagttattattggaggttgtcaatatgacccagatgaaactggtcctatatatacaaaatatcgtgaagactatgcaacaacaaactcttcacatactcctcctactaatattagtaatattcaaccgtctattactgtataccgttggataaggattgcataatgagtttacttaataataaagcgggagttatttcccgcttagcggattttcttggttttagaactaagaaaaatgatatttcgattatgaataatcagccagtaggcgctgtaacaatttcacaaatatcaaaaggtttttatgattcaaatgtagaatctgctatcaatgacgttagaaatatggcagagcaaccggttggagctgtattagttaatataagcggcgtatctcctactggcgtgcaacaaaccgactattggtcatttgaaggaactgttactgatacttcagtcaaatcaggtgacccagttattgttaacatgtttggtattccagttaaagctactaatggaatgacttcaattgaatttactagtgccgttagaatagctctacaggaaatggttgtaaaatttattgcaattgattcatttgaagaccatcctaccataggaaataaaatacaagttaagtatttagataaccaagaacatatcttagaacaatactctgataaaggaattactttcaaacaggaaataatttctccttctaaacctgggtatggaacttggcaattattaggtgcgcaaactgttacgctagatagtcacacacaacctacagtattttattattttgagagagtagcatgagtaacaatacatatcagcacgtatcaaatgaatcaaaatatgttaaattcgatcctactggatcgaattttcctggcactgttacgacagtacagtctgcattatcaaaaataagtaatatcggcgtaaatggtattcctgatgcaactatggaagttaaaggaatagcaatgattgcgtcagagcaagaggttttagatggaactaataattctaaaatcgttacaccagctacattagcaacaagattattgtatccaaatgctactgaaactaaatatggtttaacgcgttattcaacaaatgaagaaacattaaaaggctcagataataattcatcaataacaccacaaaaactgaaataccacactgacgatgtgttcaaaaatagatattcgtctgagtcatcaaacggggttattaaaatatcatctacacctgcagctttggctggagttgatgatactactgcgatgactccgctaaaaacccaaaaacttgcaataaaattaatttcgcaaatagctccttcagaagacactgcaacagaatcggtgagaggagtagttcaattatctactgttgcacaaattcgtcaaggaactctccgcgaaggatatgcaatttccccgtatacctttatgaattctgttgcaacacatgaatataagggtgttatacgcctaggaacgcagactgaaattaataataatttgggtggtgttgcagtaacaggtgaaacactaaatggtcgaggagctaccggttctatgcgtggagtagttaaattaacgacgcaagccggtattgcccctgaaggtgatagctctggagcattagcatggaacgcagatgtaattaatactcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggcgattggaataatcctggcgttcctgatatgcggggtcttttcgtcagaggagccggcacaggcggtcatattttaaatcaacgtggacaagatggctatggaaaggatagactgggcgtaggatgtgacggaatgcatgttggtggtgttcaggcacaacaaatgtcataccataaacatgctggtggttggggtgaatataacagaagtgaaggcccatttggcgcgtcagtttatcaaggatatcttggaactagaaaatattccgactgggataatgcttcatacttcactaatgatggatttgaattaggtggaccgagagatgctcatggtacacttaatcgtgaaggattaattggttatgaaactagaccatggaatatatcattaaactatattattaaagttcattactaaggattacaaatgattgaattaaaagagttaccttttgttgatagcgttcctgacgaaggtcaggaacgtatttcatggattaaaaatggtgaagaaatattaggagctagtactaagtatggaaatgatggatcaatgaatagaccaattgtttccgtgtttaaaaacgtcgaagttcttgatgaaaatgtgggaattcttaaaactgccattgaaacatcacagaaagatattaaaacaattcaaggagttttagatgtatcaggagatatagaagcactatcgcagatcagtgttaataaaaatgacatatcgaatttaaagacacttaccagtgaacacactgatatattaactggaactaataatacagttgacaaaattattgctgatataggtccatttaatgatgaagaaaactctgtttatagaacaattagaaatgatttattgtggattaaacaggaattaggacaatattctggccaagacattaacggtcttcctgttgttggtaatgctagcacaggaatgaaacacagaataataacaaatagtacattattatcttcacagggcattcgtttaagcgaattagaaaataaatttactgaatctgacgtaggatcattaactgttgaagttggtaaattacgtgatgaacttggtaataaaccagtagattttgggccaaatatttataatagattaaacactatagatgataaacaaactttaataaattctgatatagcagaaattaaatcttctattggatacccagaaaatgtttctataataacagaaattaataataacaaaagtagcattgaagctattaataatgaattaaatcagagtgaaggtgttaaacagcgcttaacggctattgaaacttctataggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctgtaaaaacgaatgaaaccaacattgcggcagtcacacatgaagtaaatacagctaaagacaatatatcctctttacagagcagcgttcaagctctacaagaagcaggttatattcctgaagctccaaaagatggccaagcttacgttcgtaaagacggcgaatgggtactactttctacctttttatcaccagcataacatggggccgcaaggccccaaaggattttaaatgtcaggatataattctcagaatccaaaggaactcaaagatgtcattctaagacgtttaggggctccaattatcaatgttgagttaacacccgatcaaatttatgattgtatccagcgtgccctagaattatacggtgaataccattttgatggacttaacaaaggttttcatgtattttatgtaggagatgacgaagaaaaatataaaaccggagtcttcgatttaagaggttccaacgtatttgcagtaacccgcattttacgcacaaatattgggtcaataacatctatggatggaaatgctacatatccgtggtttactgactttcttttaggaatggctggtattaatggcggaatgggaacgtcttgtaatagattttatggaccaaatgcctttggagctgatttaggatattttactcaacttaccagttatatgggaatgatgcaagatatgctctctcctattccagacttttggtttaattcagcaaatgaacagctcaaagtcatgggaaacttccaaaaatatgatttaattatcgtagaaagctggactaaatcatacattgatactaataaaatggttggaaatacagtaggatatggaacagtcggtccacaagatagctggtcattatctgaacgatataataacccagaccacaatttagttggtcgcgttgttggtcaagattcgaatgttaaacagggtgcttataataatcgttgggtgaaagactacgctacagctttagctaaagaattgaatggtcaaattttagcacgccaccaaggtatgatgcttcctggcggtgttacaatcgatgggcagcgtttaatagaagaagctcgattagaaaaagaagcactgcgcgaagaattatacttacttgaccctccatttggaattttggtaggttaatatggctacttacgataaaaatctttttgctaaattggaaaaccgcacgggttattctcagaccaatgaaactgaaatattaaatccttatgtaaatttcaatcattataaaaacagccaaatattagctgatgtattagtagctgaaagcattcaaatgcgaggtgtagaatgctattatgttccaagagagtatgtttcccctgatttgatatttggcgaagacttaaaaaataaatttactaaagcttggaaatttgctgcatatttaaattcatttgaaggatatgaaggagctaaatcgttctttggtaactttggtatgcaagtacaagacgaagtgactttatctattaacccaaatttatttaagcatcaagttaacggaaaagaaccgaaagaaggcgatttgatatattttcctatggataacagcttatttgaaattaactgggttgaaccatatgatccattttatcaattaggccaaaacgctattcgtaaaattacagcaggtaaattcatttattctggagaagaaattaatccagttctacagaaaaatgaaggaattaacattccagaatttagtgaattagaattaaatcctgttcgcaatcttaatggcattcatgatattaatattgatcagtatgctgaagtagatcaaattaattctgaagctaaagaatatgttgaaccttatgttgttgtcaataatagaggcaaatctttcgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcgataaattcacaagaagatgtagctaaagttgaaactattctacctcgtataaatttgcatttagttgattttagctataacgctccatttaaaacaaacattttaaatcagaatttactgcaaaaaggtacaacttctgtagtatcgcagtataatccatctcctattaaaatgatttatgaattgagtatctttactcgctacgaagatgatatgtttcaaatagttgaacagattcttccatattttcaacctcattttaatacaactatgtacgaacagtttggaaatgatattccatttaaaagggatattaaaattgtactgatgtctgctgctatagacgaatctatagatggagataatttatctcgtcgtagaattgaatggtcattaacatttgaagtaaatggatggatgtatcctccagtagatgatgcagaaggattaattcgtactacttatacagattttcacgccaatacaagagatttgcctgatggcgaaggtgtttttgaatctgtcgataatgaagttgttcctcgagatattaacccagaagactgggatggaacagtaaaacaaactttcactagcaatgtaaatagaccaacaccgccagaacctcctggcccaagaacatagaggttattatggaaggtcttgatataaacaaacttttagatatttctgacctccccggaattgacggggaggaaattaaagtatatgaacctctgcaattagtagaagttaaaagcaatcctcaaaaccgtactccagacttagaagatgattatggagtagttcgtcgaaatatgcattttcaacaacaaatgctaatggacgcggccaagatttttcttgagacagcaaagaatgctgattctcctcgtcacatggaagtatttgcaactcttatggggcaaatgactacgacgaacagagaaatactgaagcttcataaagatatgaaagatattacatctgagcaggttggcactaaaggcgctgttcctacaggtcaaatgaatattcagaacgcgacagtattcatgggttcaccaacagaattaatggacgaaattggtgatgcttacgaggctcaagaagctcgtgagaaggtgataaatggaacaaccgattaatgcattaaatgatttccatccattaaatgaagctggaaaaattttaataaaacacccaagcttagcagaaagaaaagatgaagatggaattcattggataaaatcacagtgggatggaaaatggtatcctgaaaaattcagtgattatcttcgtttacacaaaatagtaaaaatcccaaataattctgataagcctgaattatttcaaacttataaagataagaataataaaagatctcggtatatgggtcttcctaacttaaaacgagctaatattaaaacacaatggactcgtgaaatggttgaggaatggaaaaaatgccgagatgatattgtatattttgcagaaacatactgcgccattactcatatcgactatggtgtcataaaggttcaattacgtgactatcagcgtgatatgctcaaaataatgtcatctaaacgtatgactgtttgtaatctatcacgtcagcttggtaaaacaactgtagtagctatttttcttgcacactttgtatgttttaacaaggataaagctgtaggtattcttgcgcacaaaggttcaatgtctgcagaagttttagatcgtactaagcaagcaattgaactgcttcctgactttttacagcctggtatagttgaatggaataagggttcaattgaactagataatggttcttcaattggcgcttatgcttcctctcctgacgcagttcgtggtaactcattcgcaatgatttatattgacgaatgtgcatttattccaaacttccatgattcctggcttgctattcaaccagtaatttcatctggtcgtcgttcgaaaattattattactacgactcctaatggattaaatcatttttatgatatttggactgctgccgttgaaggtaaatcagggtttgaaccatacaccgctatttggaattcagttaaggaacgtctttataacgatgaagatatttttgacgatggatggcaatggagcatacaaaccattaatggttctactttagcacaattccgtcaagaacataccgcagcgtttgaagggacttctggtacattaatttcaggaatgaaattggctgttatggatttcattgaagtaactccagatgatcatggttttcatcgatttaaaggacctgaaccagatagaaaatacattgcaactttagactgttcagaaggtcgtgggcaagattaccacgctttacatattattgatgttaccgatgatgtgtgggaacaggttggtgttttacattcaaataccatttctcatttaattctgcctgacatcgttatgcgttatttagtagaatataatgaatgtccagtttatattgaattaaatagtactggtgtgtcagttgcgaaatcactttacatggatttagaatacgaaggcgttatttgcgattcatatactgatttaggaatgaagcaaactaaacgaacgaaagcagtcggatgctctacattaaaagaccttattgaaaaagataagcttattattcatcaccgtgcaactattcaagaatttagaacgtttagtgaaaaaggcgtgtcttgggcggctgaagaaggttatcatgacgatttagtaatgtctttagtaatttttggatggttatcaacacaatcaaaatttattgattatgccgacaaagatgacatgcgattagcatctgaagtgttttcaaaagagcttcaagatatgggggatgaatacgctccagttatatttgttgattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaacgaagtagatttagttaatacttttggtcaacctacagctgaaactgctgactattttatgtctgcaatgaatttcttacaatatggaaatgatttgcgagttgtgcgcgctgtcgatagagataccgctaaaaactcatctccgattgctggtaatattgaatacacaatttctaccccaggtagtaactacgcggttggagataaaatcacggtcaaatatgtttcagaagatgttgaaacagaaggtaaaattaccgaagtagatgctgatggaaaaattaagaaaattaatattcctactgcaaaaattattgctaaagctaaagaagttggcgaatacccaacattaggttctaactggactgcagaaatttcttcatcttcttccggtttagctgcagtaataactcttggaaaaattattactgattctggtattttattagctgaaattgaaaatgctgaagctgctatgacagcggttgactttcaagcaaatcttgaaaaatatggaattccaggagtagtagctctctatccaggcgaattaggcgataaaattgaaattgaaatcgtatctaaagctgactatgcgaaaggcgcttctgcattactgccaatttatccaggtggtggtactcgtgcatctactgccaaggcagtatttggatatgggccgcagactgactcacagtacgctattatagttcgtcgaaatgatgctattgttcaaagcgttgttctttcaactaagcgtggtgaaaaagatatttacgatagtaacatctatatcgatgactttttcgcaaaaggtggttcagaatatatttttgcaactgcacaaaactggccagaaggcttctctggaattttaactctgtctggtggattatcatcaaatgctgaagtaacagcaggagatttaatggaagcttgggacttctttgctgaccgtgaatctgttgatgttcaactgtttattgcgggttcttgtgccggtgaatctttagaaacagcatctactgtccaaaaacacgtcgtttcaattggggatgctcgccaagattgcttagtattgtgctctcctccgcgtgaaactgtagttggaattcctgtaactcgtgcagtagataatttagttaactggagaactgcggcaggttcatacactgataataactttaatatcagttcaacctatgcagcaatcgacggcaactacaaatatcagtatgacaaatataatgatgtgaatcgttgggttccattagcagctgatattgccggtttatgcgcgagaactgataacgtttctcagacttggatgtctccagctggttataatcgtggtcagattcttaacgttattaaacttgctattgaaactcgccaagctcagcgcgaccgtttatatcaagaagctatcaacccagtaactggtacaggtggtgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccaatacttacagggaattaaagctctcggtggaatttatgaatatcgtgtagtttgcgatacaacaaataacactccgtcagtaattgatagaaatgagtttgttgcaacattctatattcaaccggcgcgcagtataaattatattactttgaatttcgtcgcaactgctactggtgcagatttcgatgagttaactggtcttgctggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagttggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagaacgctattgttcgtcaatatgctcgtgatgctaaaacagtaacaaaagaaattgaaattaaaggtctgtggcctactaacgtgggtgaacttcaattagattgggattcaaacaatgaaatccaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtagataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggtgctgataatactggcaatatggaagatattcgttggtttagacaagctctttacatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccacttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtaccaatgcttgaatctcatgatggaaaagacttaggtttaaaaccgggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccacggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgaacacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgctgcaggtcagacttctggagcagtaactcagattggcccagctgttatgggtatggtacgtcgtgctattcctaacctgattgctttcgatatttgtggtgttcagccaatgaatagcccgactggccaggtattcgcactgcgtgcagtatatggtaaagacccaatcgctgctgatgctaaagaagcattccacccaatgtatggtccagatgcaatgttctctggtcagggtgctgctaagaaattcccagctctggctgctagcacacaaaccaaagtaggtgatatctatactcacttcttccaggaaactggtactgtatatctgcaagcttctgctcaagtaacaattagttctactgcagatgatgcagctaaattagatgctgaaattaagaaacaaatggaagctggcgcattggtagaaatcgctgaaggtatggctacttctatcgctgaacttcaggaaggtttcaacggttctaccgataacccatggaatgaaatgggcttccgtatcgataaacaagttatcgaagctaaatctcgtcagctgaaagctgcttactctatcgaattagcacaagacctccgcgctgttcacggtatggatgctgatgctgaactgtctggtattctggctaccgaaattatgctggaaatcaaccgcgaagttgttgattggattaactactccgctcaggttggtaaatctggtatgaccctgactccgggttctaaagctggtgtatttgacttccaggacccaatcgatattcgtggtgctcgctgggcaggtgaatcctttaaagctctgttgttccagattgacaaagaagcagttgaaattgctcgtcagactggtcgcggcgaaggtaacttcattatcgcttcccgtaacgtagttaacgttctggcttcagttgataccggcatttcttatgctgcacaaggtctggctactggctttaacactgatactaccaagtcagtatttgctggtgttctgggtggtaaataccgtgtatatatcgaccagtatgctaaacaggattatttcaccgtaggttataaaggtccgaacgaaatggatgctggtatttactatgctccatatgtagctctgactccgctgcgtggttctgatccgaagaacttccaaccggtaatgggattcaaaactcgttacggtatcggtatcaacccatttgcagaatccgctgctcaggctccggcttctcgcatccagagcggtatgccttctattctgaatagccttggtaaaaacgcttacttccgccgtgtatatgttaaaggtatctaatctttgacgatttaagggaccttcgggtccctttagttgtttttatggtataaataaatcatataaactgaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaactggtgctacttacgccggcgaagctggatatgtagaccgagaacaaatcacagaattaacagaagagtctaaattaactctcaataagggcgatttattcaaatataataatatcgtttataaagtattagaagatacaccatttgctgatattgaagaaagcgatttagaattagctcttcagattgcaattgttcttttaaaggttcgtctattttctgacgcagcgtcaacaagcaaatttgaaagctctgatagtgaaattgcggatgctagattccagattaataaatggcaaaccgcagttaaatctcgtaaacttaaaactggtatcacagttgaattagcacaagatttagaagcaaatggattcgatgctcctaatttcttggaagatttgcttgcaactgaaatggcagatgaaatcaataaagatattctgcagtctttgattacagtgtcaaaacgctataaagttacaggaattactgatactggattcatcgatttgagttatgcatctgcacctgaagctggtcgttcattataccgaatggtatgtgaaatggtttcgcatatccaaaaagaatcaacttatacagcaacgttctgtgttgcttcagctcgtgctgctgcgattcttgctgcatcaggttggttaaaacataaaccagaagatgacaaatatctttcacaaaatgcctacgggttcttagctaatggtttaccgctttattgcgatactaacagcccattagattatgtaatcgttggcgtagtagaaaatatcggtgaaaaagaaattgttggatcaattttctatgctccgtatacagaaggtcttgacttagatgaccctgaacatgtaggtgcatttaaagttgtagttgatccagaaagtttgcagccatctatcggtttattagttagatatgctttatctgcaaatccttacaccgtagcaaaagatgaaaaagaagcaagagtaattgatggtggagacatggataaaatggcgggtcgttcagatttgtctgttttattaggtgttaaactaccaaaaattatcattgatgaataaaacaaagggacctttcggtccctttttatttaacttaccaattcaatccaagccggacgaagtacatcttgtaccattttaactaattcctttttaatcaaagaaggattatctgcttgagttagagtaataccttcacgagaagtttcttccaaaatatcttgaacagttagtcccatcacctttccaaaatccttcggaccaatttcaccaattttagaaataacgttatttactcggttcagtgtaacgtagcaagctaaaattcccaccaatttgttatcagcttctgatagttcaactttagctttaataggcttatcagactttttcttttcactaaatttggaattcttgcatttgatggctacacgatttccattatgaagccaagaaggataacaaggtttcaatacatatccttcagcggtaaatacttcgcctttggcttcagctttccaaacacatttgttagcgtcaactaatcctgcatggtctactgtaaaattataatcttggacgacagaatctaaatcatttggcaatttaataagctcttcaaatttaccgcgacctaaaagtggagccattttaaatttaaatgtattacaaaatgattccatcatataatcatcgacataagtcacatcaccactttctgtagtgacaataatgtcaaatacataaaaatctttatcgccataatcgacattcttctgaatgccaggtccagcgaattcgccaaagacttgataagatacaaccgctgaggtttccataatatcttgtactgctttaatagaatcttcgtaattctttagaataatttcatacccaaagaaatcttcagcaggaagaattggtccagtacgtttagcgcaagttactttatcacgctcaataatcaatgagaaatttgtgccgtgaatcttttcacgagctacccactccccaccagtcaatcccaagctataaagtttttcaataaatttagagttgtaatgattttcaagactgctatactttttaaacataattaatcctcaaaatgtaatttctaaccaatcaccatcacgctgatcactattgactttaaagctgaatccttcttttctcagccaatcaccaatttcttcagtaatcaatttatcacgagcaatacaataataactaaaatgtgttttaccttgttcagctgctttattagcaagttccgaaaaatctttaataaaacattctagtttaaactgtttacttttaagtgctttttctcgcaattgattagcaaaagattcattttcataaagatcatactgttccatttttcacctttttattgatatgtctttttctatagacgactttttctcgagtttcaaatttattcttagcagtcatagctcgagcccataatacagccacttcttttgcctgtaagtttaattcacgagcaatttcaatgaatgactttccagactcatgaagagtaaacaccacaacctcagttctcataattaatctcatgttatcgagttggtgccattatatacatcattttctgattgtgttttgcgtgctttcaaaatgaagaaaggggccgaagccccttatgattatggataggtatagatgataccagtttctaaagcagttttatgaatgatgtatccattacgcgattcttgaacatcaacttctggatagtctttcatcatcttctgaagagtgtaacgatgtaggtaatatttactatctgggtcgtcagttttccaatctttaccttcttcggtcattttttggatttcatccataacccaccaaccgcaccagatataagctgaagtacgatgtggaagaggatgaacataaggtagttcaccttctggttctggagcaactttatcagttacctgaacttgaccttctgctgtaatagttttgctatcgtaatcagttgcagtaacgacagcagtaacttcaatagtttgacttccaacagatgaggtatcgacagtatatacgttagttgacccttctacaggagaagaatctttcttccatgagtaagtaatttgtgcttcttctggagcacccgtaacattagccgtaaatgtagccgaagcatcttgctgaacattaatagaaggaggagtcaatgtaacctgtggattcattgtcttcttattaactgtcaatgatacttcattagaagtaacttccttttcattgtaattttcagcagttacttgggctacgcatttaattctttttactccacttgtagttggagtatagctaaatgtagagttagtttctccaccaacttgtgaatcatctacataccactgatacgtagcagacgctccatcaggttgagaagctaaggcagcagtaaattgaactggggttccgattactcccgctggaggactatcaggagttactgccaaagtagttgtctgctcctttttattaacagtcagtgatacttcattcgaagtaacttcctttgtatcataatctgtcgcggttacttgagctacacacttgatttttttaactccgcttgtgtcaggagtgtaattgaatgtagtgctagttgcttcgcccacaggagaaccgtcaacgtaccattgatacgtagcgtttgcacctgatggctgtgaagctaaggcagcggtaaattcaattggagttccaatcactccagcatcagggctaccaggagttactgccaaagtagttgtttgtgtcttattttgaactgtgatagttgtactaatttcagctgtttcaggttcagattctgcaacttgattggttgcaactactttaatagtcttttgaccggcaggtccttttagtacataactaaaagttgctgacgtttcttcctgtggagcgtcgtctacagtccaagcatatgtaataggtccatctccagtttgaccactgggtgcagcagtaaactgctgagtctgatctataactccagtaggtgttttaggagttatatcaactgtaaaagccataagttatccttattttaatgttacgaaagaagaattacgtgtttcacgaattagaactgatccgtcacgattaatgtagtaaattaagctaaataaagtttggtgtgctgacgcatgttcaaaactagttgggtgagatttccaatctggggtttcagcaatccattgataaatccaccaaggaacagtgcagaatcctggattttttccaatcagctgaagattcggactaaagttttccggaagagtaaatacagacggcttttcagattcaataatctcagctacagcctgttcgaatttttcttcaacaaaaggagtatcttcaattaaaacagtggtattttcaggaattttatccgtttctactacttcaattttaatgtcagatttaaccggagaatcaatcagaagtgctgcctctggattgacttcttcatcgtcatattttaatccgtctgcggcatcagcagcatcaattaagtctttaatagataacccatcagtctctggcataggttcactagcgagcttctggagagcttcttcaatatcattaacgatattatcaaaagatttattctttttgacctttataccaaactgttcagcatattcagctaatttagctttagcttctttattatcatcaagagccttcagctctgcaatataatctttatctatcataatatttcctcagtataaatatagatatatttattacatggtatttagacatgactgacattaaagtacatttttatgattttagtcacgtgagaattgattgcgaagaaagtacatttcatgaactccgtgatttctttagctttgaagctgatgggtatcgttttaatccgaagtacaaatatggccactgggatggacgaattcgtcttttagattataatcgccttcttccattcggtttagtcgggcaaattaaaaagttctgcgataactttggctataaagcctggattgacccgcaaattaacgaaaaagaagaattatcaagaaaagattttgatgaatggctttctaaattagaaatctattcaggaaataaaagaattgaaccacactggtatcaaaaagatgcagtgttcgaaggattagttaatcgtcgtagaattcttaatcttccaacatctgcaggtaaatctttaattcaagctttgcttgcgcgatattatttggaaaattatgaaggtaaaattcttatcattgttccaacaactgctttaacaactcagatggctgatgacttcgttgactatcgtttattcagtcatgcaatgataaagaaaatcggtggaggagcatcaaaagatgataaatataaaaatgatgcaccagtcgttgttggtacatggcaaactgtagtaaaacaaccgaaagaatggttctcacagtttggaatgatgatgaatgatgaatgccatcttgctacaggaaaaagtatttcatccatcatatcaggtttaaataactgcatgttcaaattcggtttgtctggttcattacgtgatggcaaagctaatatcatgcagtatgttggaatgttcggtgaaatatttaagccagtaacgacctctaaattaatggaagatggacaagtaactgagttaaaaattaatagtatttttcttcgctatcccgatgagttcactactaaattaaagggaaaaacttaccaagaagaaataaaaattattactgggcttagtaaaagaaataaatggatcgctaaattagctattaagcttgcacaaaaagatgaaaacgcttttgtcatgtttaaacacgtatcgcacggtaaagctattttcgatttaattaaaaatgaatacgataaagtttattacgtatcaggggaagttgataccgaaacccgcaatataatgaaaaccttagctgaaaacggtaaaggaataattatagtagctagttatggtgtattttctactggtatttcagttaaaaatctgcatcacgttgttttagcacacggtgttaaatctaaaattattgtattgcaaacaataggtcgcgtattacgtaaacatggttctaaaacaatcgcaacagtctgggacctcatagatgactgtggtgtcaagccaaaatctgctaatactaaaaagaaatatgttcacttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgcgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaagaacatcttcaccgcacgggtggtcggccaggatacgaatatcctgacgcttaagattatgctttttcattaagaattgaatttccgtttcaaattcttcttcataattaaaagcatcatcaatgctatatctcattattttccagcctcaaatgctcgcatgtcttgaatatgcttaatagcaaatccacgtgatttaatagcatcaagagctccgctacagaaatctaataaaatcccccaatactgtaacgaggtatcaacctttaaaacatccttatcagctgatagaactgtcttcatttctgatttctcgtaacgatccatactaaattcatcaccatctcctcgtcccgagtagtagtctaatttagctttaagagcaacttttttctgtgcatcaattctaagcatttcctttttaatacttgaatgcttattaagccatttactatataacatcacattattagctgcttcatactgtaatttagtcgaatctataaatacatctttcttcaattcttcttgaagatcttctaatctcatattgttctctattcaattgttattggatggacttagattcattataccacgtttatacgtgaagcattatactctattactggaagccagttgtagttttatttgctcaatatcatcagggttatcgatgactgaaaagcgtatttctactatcaaagtataatcatcataaaccggtattacattaactgctaatttatcaatacgtggctcatagtttcttactgcgctttcgatattacgctcaaccgtgtcagcagtaagaggagtcatattctcaaaaagttggtcagataaatcgcatccaaattcagggtcaaacggtcttgaaccttttcttgttgtaataattcctaaaagactatttttaattgaccttaatccaagtgatcttgaaacgtctttgttccaatccattttcatctctgggtcaatatcagaataaagcttattaatatttgccattacaatagctcaaagaattctttgagtcctcttattacatgagcgtgagtttttccacactctggacatttaattggaacagccaaataaacagtaggctttaaaagcatatcttttatagctacaatatctgactctgcgatgatagaatataaatcttccagttctttttcatttaagtcttcaactggaatgctttcaccgttagcatgaatcgtttctatacatgatactatcatgtgggctatatttttatcatcaaaaattttagggtaatggaatttaattttaatgtcacccagtgtataccagaggtcttctggtgcatctatttgtgtatgtaatagatttatatgggttggtatttcagttccacaggtgcacttccaggagttttcgtgattaacttctccaagagaatgcgcccataaatgaatcagtaatagttctgattcttggcggtttaaatcttttgcatttgtacagtctttgattagctttttaacaatctcttctactgaaccattctttttagcagtaataagttctagatattctttaagagtaaatgcgcgacagttgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagaacatcggtcaccacaagaacaaaaagaagtaattgctgatttaattgctgattattttggagactatccaaagacttggcaaccatttatatttttgcaggtatttgtaggttcaataggtaaaactaaagtaccggtcacatttgtatgtccaaaatgtaaaaaagaaaagacagttccatttgaaatatatcaaaaagaattaaaggaacctgtttttgatgtagctaatgttaaaattaaattaaagtttccttctgagttttatgaaaataaagcaaagatgattactgaaaatattcattctgttcaagtagatgaaatatggtatgattggaaggaaattagcgagtccagtcaaatagaactagttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgagcgcggattcgtattaaaactgattgagaaggataaacatcaatgagtatgttacaacgtcctggatatccaaatctcagcgttaaattatttgagagttatgacgcttggagtaataatagatttgttgaattagctgctactattaccacattaactatgcgtgactctctttatggtcgaaatgaaggaatgctacaattttatgattctaaaaacatccatacaaaaatggatggaaatgaaataattcagatttctgtagctaatgcaaatgatattaataatgttaaaacacgaatttatggatgtaagcatttttccgtgtcagtagattcaaaaggcgataacatcattgctattgaattgggaactattcattctatagaaaatcttaaatttggtagaccatttttccctgatgccggtgaatctataaaagaaatgcttggtgtcatttatcaagaccgtacattattaactccagcaataaatgctataaatgcttatgttcctgatattccatggactagcacatttgaaaactatttgtcatatgtcagagaagttgctctagctgtaggaagtgacaaatttgtatttgtatggcaagacatcatgggagttaacatgatggactatgatatgatgataaatcaagaaccatatccaatgattgtaggtgagccaactttaataggtcaattcgtccaagaattgaaatatccattagcatatgattttgtttggttgactaaatcaaacccgcataaacgtgatccaatgaaaaatgctactatctatgctcattcgtttttagattcttcactgccaatgattactacaggaaagggtgaaaactctattgtagtgtcaaggtcaggtgcttattctgaaatgacttatagaaatggctatgaagaagctattcgtcttcaaactatggcgcaatatgatggctatgctaaatgttctactgtcggtaattttaacttgactcctggtgttaaaattatttttaatgatagtaaaaaccaatttaaaacagaattttacgttgatgaagttatccatgaattatcaaataataattcagtaactcatctatatatgttcactaatgcaacgaaactggaaacaatagacccagttaaggttaaaaatgaatttaaatctgatactaccactgaagaaagtagttcttccaataagtaataaagaagtttctattcctaagatgggtcttaaacattataacattttaaaagatgttaaaggtcctgatgaaaatttaaaacttcttattgattctatttgtccgaatttatcaccggcagaagttgatttcgtttccattcatttattggaatttaatggaaagattaaatcccgtaaagaaatagatggttatacttatgatattaatgacgtttatgtatgtcaaagattggaatttcaataccaaggaaatacattttattttagacctcctggaaaatttgaacaatttttaactgtaagcgatatgttatccaaatgcttgcttaaggtcaatgatgaagttaaagaaattaattttcttgagatgccagcatttgttttaaaatgggcaaatgatatttctacaactttagcaattcctggccctaatggtccaataaccggaattggcaatattattggattatttgaatgaaaaagccacaagaaatgcaaacgatgcgtagaaaagttatttcagataataaaccaacacaggaagcggctaaatccgcttctaatactttatctggtcttaatgacatttctacaaaattagatgatgctcaagctgcctctgaattaatagctcagactgttgaagaaaaatcaaatgaaatagttggagcaattgataacgttgaaagcgcagtaagtgatactactgccggttctgagttaattgccgagactgttgaaattggcaataatatcaataaagaaataggcgaatcactcggaagcaaattagataaattaacgagtttattagaacaaaaaattcaaacagctggaattcaacagactggaacgagtttagcagtagtagaaaatgctattcctgttaaagtcgtcgaggatgatacagctgaatctgtgggtcctttattaccggctcctgaagcagttaataatgatcctgatgctgattttttccctactcctcagccaattgaaccaaaacaagagtctccagaagagaagcaaaaaagagacgcatttaacttaaaattatctcaagctttagataaattaacaaagacagttgatttcggatttaagaaatctatttcaattactgataaaatatctagcatgctatttaagtataccgtcagtgctgctattgaagctgctaaaatggttgcattgataatggctgttgttattggaatagacctgctgatggttcattttaaatactggtcagataaattttcaaaagcctgggatttatttagcactgattttaaaactttctcaagcgaaacaggaacttggggccctttattacaaagcatctttgaatctattgatgaaattaaaaagttctgggaagctggagattggggcggattaacagtagctattgttgaagggcttggaagtgttctttataatttaggagagcttattcaattaggtatggctaaattatctgcagcaattcttcgagtcattcctggcatgaaggatactgctgatgaagtagaaggaagagcattagaaaatttccaaaattctactggagcatctcttaataaagaagaccaagaaaaagtagcaaattatcaagataaacgaatgaatgatgatcttggcccaatagcaaaaggattagacaaaattgcgaactggaaaactcgtgcatctaactggattcgtggtgtagataataaagaagcattgactactgacgaagaacgtgcagcagaagaagaaaaattaaaacaactttcaccggaagaaagaaaaaatgctttaatgaaagctaatgaagctcgtgctgcgatgattcgttttgaaaaatacgctgattcagctgatatgagcaaagactcgacagttaaatcaattgaagctgctcatgaagaccttaaaaaacgaatgaatgatccggatttaaataattcaccagcagttaaaaaagaacttgcttctagatttgctaaaattgatgccacttatcaagagctcaagaaaaatcaacctgaagcaaaacctgaaacttctgctaaatcaccagaagcaaaacaggtccaggtgattgaaaagaacaaagcacaacaagctcctgttcaacaagcatctccttcaatcaataatactaataatgttattaagaaaaatactgtcgttcataatatgacacctgtcacaagcacaactgctcctggtgtatttggtgcgacgggagttaattaaggaataatatggcaattgttaaagaaataactgctgatttaattaaaaagtccggtgaaacaatttcagccggacagagtactaaatcagaagtaggaactaaaacatacacagcccagtttccaactgggcgtgctagtggtaatgacactacaggggacttccaggtaacagatctatataagaatggattattatttactgcatacaatatgtcatctagggattctggaagtcttagaacgatgagatctaactactcttcttcatcttcgagtattttacgtacagccagaaacactatcagtaatacagtatcaaaactatcaaatggactaatatcagataataattcaggagcaataagtaaagttcctgttgcaaatattcttttacctagatctaaatctgacgtcgatacgtcatcacatagatttaatgatgttcaagatagtcttattacaaaaggtggaggtactgctactggtgtgctaagcaatatggcttcaaccgcagtatttggagcgctggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatttagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgataaaacacctaatggtaactttaacggattagctattgctccaaatctccctagtacatttactctcgagattactatgagagaaattatcacgttaaaccgtgcttctttatatgcggggactttttaatgtattctttagaggaatttaataatcaagcaataaacgcagatttccaacgtaataatatgttcagctgtgtttttgctacaactccatcaactaaaagctcttcgttgataagttcaattagcaacttttcttataataacttgggcctaaattcagattggttaggattaactcaaggcgatattaatcagggaattactacgctaattacagctggcacacaaaaactgataagaaaatcaggggttagtaaatatcttattggtgccatgagtcaacgtacagttcaaagtttattaggctcatttacagttggtacatatttaattgacttctttaacatggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggcagatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtgatgcaggctggagcagttgatagacaagctgccattgaatggcttgaatctgctactataaatggtattcaaagcgttctcggaaatagtggaggtgttactggactatctaattcgctttcacgacttagtagattagggggaactgcaggaagcatttcaaatattaatactatgacaggaattgtcaattcgcaaagtaaaatattaggagcaatataacaatggggacctttcggtccccatatttttatttacggaatgaaatgaaagcagcaactgaagcaactaaactgtcttcaatataaacttcaatttttaccggagcttctgactcaaatttacctgttactacaccctgaaaaatactttcagtctgttctggctttgaaaaattttcagaaggaaaaattccgaactttttatctgttccaaaaattttgataaattcatcgtaaactgcttcattaaaagcattatcagcaggaataacgccttcaactacaagttcttgacctaaaaagcgcaaagaagatttcattttgtgttcctcatgttatgtcagtaagactactataacacaacacgagggacttgtaaactacatcttgaactttttagacattccgttgatgttaaccaaagaagctaagatttgagaaacttcgttttcctcttcttttgattcttctacaaggaattgattaaatccagccattggacgaacttcaccagtttccatcaaatgatcgccatcatatactgattcttctaattgctcagaaggaggaacgattgtaccttcgattagatacttgttataagcagtttctttcataaagtaagtacttactttattaatcttcagtaaaattccacgcggtagaataacttcagcttctgatggaaatcctgataaatgacccggaacgataactttgattcgctcagctcctttaattaccatacccacgctagtttcagcatcttcattagcatatgtagaatgactacccatatgcatcaaatcttctgcatcaacggaaccttctccttcaccagaaaatactgcaccggaatcatctagagccatatagtttttaccatgctcgccgaagatatttggtttaagcgatgtagatacgaagttcttgaaatagaacattttgttttcaatgttatgacgcaaagttttaaaggtaacttcttgtccacggtaaagtgtagttcctggaggaagaactgatcctttggcaaaggcagaatccattgtctcgatgtgtttaatagctcgttccatatattcttcacgggtagaatctggtttacccaaaaggaacgagttcatttcaacatatgaatctgcacaataatcttcaattacatcggactcagcctgagttaatccttttgggggtacttcagtacttgcatattcatacgcttgagaagcagactcattaatcaatttataaatgccattcatgacaaattgaataatagctatcttttcatctggcgtggctttagaacctttaactaaatcattgacaattttcttaataacatcaaagctattagaaatattaatgtcagcaagatcgcttaaaattttatcggttttataatcaaagaattctttattctttaaatattcttgagaaccttgatatgttatatcgctctgcagtctgatagacggatcacgtaaacgtgcatgggccaatgcaatatgatttcggaagctttctagttcataatcgttagatttaaaacgagaagcacttctcataccaccgatagctcctttgccgaagtttgaaccaatctgaataacgccagagttcattggtccttctgctttatataccggaactttagattcaaactcttgatatttcttagcggcgaagctatcaccctgaagtgaagcatcgacagtagaatattgagcttgtgctgctaatcgacgactaattttagttttctgaataacagcttgatccgtgcgcttatcattttctagagcaatagaagcggcaacagcaacagctttaggaacagcattacctgttttaacgtctacataaacatcaccaacctttgattcaacctttgtgaataactcagttgaaataggaggtacacctggaatatcttctaaattggcatttttacggtaaaccataatatatgcatatttcttatcatagtcccagatttcctttaaaagaacatatcgacctgctcctttagtacgtactaaacggtcagcaataacttgcatttgacgagctgcaccgtttgttttactctttagtacgcggaataggcatgcgtcaattttatactgtttcattgtttgaagagcagtatcaaaaaccgcattaataacaccaattggatttccacccaagtttctaagtttaaccagtgataatttctcgttgacacctatcattacgatatgcatcattttatcgcctggcttaacgtttttatttgtatcaccgccagaggtgtatgtacaaaatctaaatccaggaagcacactttcttcaccggcttgaatagcaaaaatttgaggtattttatgcttaggatttaagttaacaaccggcgccgaagcgccgtcaaataattctgtaataagttccatgatttatccttgaacgaacttgtaaggcatgtttgtaatatctatgcaagacgcaataattccaagagatgattctactttttgtttaacatttgatgaaacaaatgatgcaaagtcaactctgtcttctatttcaatatcacctgtcattgcaactacttcaccagtttccattagacggtcaccgtcataaatgactgattcggtgagttcttctgtagtcataacttcagcttgaatgagttttgtattattagatgttgttccatcattattagaagcatcagttattttattaactttgaccatcaatccgcgtggtagaataacttcagcttctgttgctattccgagacttcctggatatacaacattaactttatgagctccatcaattgcccatcctatttgaactttaacgtattcaggattttctttatacgctcttatttcgcttggattaatagttattccttcttcatttttatcaactgttaattcattacgagcttctggttctaaaagaccaatgccagcatgtgtaattccaaaacgcccaaaaatgataggagttaaagaagtagatacaaaatttctgaaatagaacactttatttttaactagtgcttcgtatataggagcagtcatactttgagcacgataaactgtaatgccttctggtatacggtcaccattttcaaaagctgaatctaagttatttatagtagattcaatttctttttcactcattacatcatatcgttctggattgtagcgtcctaaaagaagattattgatgtcagtatatcctgaaccgcaatactctctaatgccacgcttttgtgatggagtatatttagaaccatcacgggcaatagtaatatcaatcatcggacctgcaccaattccagaaaaactataaatcattcgtttgaggaatttagtttttgctgcgttccaggaatttttagttatttcttcccagacttcatctggctgtcctttacgggttttattatgtttatcaagccaagtatctttatattcttcaaagaatttattaatagctgctgcatacttctctaaacattttattgaagtagttggttcatttttgatcgcgttaaaaattacgtctttaattttttcagaaacttcattaacctcactttttgaaaagaatttataatcatagtgaagttcatctgcagttccttcggcaataatttttgctgccttagttttagaagccaatgaattaattccaagtttcatttcttctgcttcgggaattaaaggtgcagtagcaggtttattgaaattagctgcggtagattcatacttctggaataattcgctttcaaatctagaagattctaatgattgactttgtgcaattgctctacgggaaattttaactttaacgattacagcttggtcagaacgtttatcattttcttgcgcaatagatgcagcaattgcctcatttttagttacttgagctccagtatctttattgatataaacatcaccgaccttcgattcaactttagtaaagagctcggtgctaatttccggaactcctggaatgtcttctagtgatacatttttgcgatgtataagaatatatgcatactttttatcgtaatcccagagttccttaagaaggacgtatctgccacccgaacgactacggataagtctatcagcaataacttgaatttgtcgagcttgaccagcagttttagacttaagaatacggagcatacaggcatcaattttatactgacgcatcgtctgtatcgcaacagtaaaaactgaattgatgtaattaattgggcttggaccgagaccttttaatttagcaattgaacctttagcagttaatgtaaaaggaacaatatgcatcattttatcgcccatctttagatcacggttagtatcacctccagatgtataggtacataaacgaaagcctggttgttcaattgcgtcatcaacatgaactgaaaaaatttgtggtattttcttctttggatttaagtttgtaatcggaagagtagtatcttcgtcaaataattctgtaatgagttccatcatatcctctctagtgtttattctatttataaaattaaaggcccgaaggcctttaataatctattggtaagagagtacggtatatttcaaactttggacctttttcataggcatcaaatgtttctgtgaatttattataagcatatgcatctataaattcaatcataatttgtgatacagaagtagaaacatctccaccttctttttgagcaacgacaattgtttctaagtaagctttcatagaccagttacctcatgaaaatcaccaaatacatcttcgaatgtattagctttagttttatcttcacgcaaacgaatcgcaatcggaagaaataatttaacgtaatcagtgcggccatcagattttaaccaaccgttgcattcgcactctagaatttttccaatataataattttggttttccataatgcgagtacggtcaagttcatgcgattttacaccggctttatcttttaagcctgaacctgcatttactttaatttttccacactctgactcaagaataaatccacctgctttagtagggtctttacggtgaggataaattcctacaatttttaaatcaacatcaattacttctttaaatttatagagattttttgaacgagcattttcccataatccatcgatatttttgagaataataccttcaagaccttggtcaatatactttttataaattaccttggcttcgtctaggttatttactacctggttttcaattaaaattactttatcatagcctgatgtcatttgttctagtttagaaaaacgtacatcatatttcaaacgaaatgcaggaagaccgtatatttctaccaacggtacataatcccagacctgaaacttcatgcattgtgcttctttttcagaaatggttccctttaaagatttattggcgatgccattagatgcagtacgtgattcagctacttcggcgaattctttagctttactgttttcaggataagcatcaaaaagaaaatctaggccttctggctccttttcaacttgctcatggtataccaattcgccatcaattaacacgccttctggatgaatctggcgggcttcagcggtcattttgattaattcttccttaagaagatctaatcctagatattcattaccagctcgtgataaaagacgaacgtcatctaattcatcacctctgacttcggcaaagcaccgagctccatcagcttttaactgggcaaaggctggaaatttgatattcttattaatgcctttttcatcataagaacttgcgagcatttgaggttgttcaggaattaaacctggccaaactttgtttgcaatagatactgaagcaccgcattcaaggtctcgcatcatcacccgacgcaaaacttcaacatcatcttttttaccgtcagtaatatatccagttaattcctcaattgccgcatttccagtcaatttccgagtagctaacgtgaattcaatgaagtcaagcatatcggtaatagtcagcattccaaaactctgggtagcaataccaggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacgtaaatgaaaccttgctctacacattttttaaaaattcgttcgtctttttgagctcggaattctggattgcatctaaaaaattgatttacgtgaccgtaatcacgtgtagtattaccttcattttcataaatagtgtgaacaacaaacattagaatgctccttggaaaatattatcaccactagtaaatctattaaaataccctgcatcaccaggcttagtataactccacgtatggaatggattcatatgatacgggtgtgtataatatggattatatggatgtgtataatatgggttatacggattaaatccaggagttctccaggtagtgttccaacgaaaagaatcgtttttaaccatcttcttaattacatcttttatagctttttcactatcaaaactttctttattttccttcgatggaaaaagcttattctctacatcattccatgtataaactcgctgtgcagtttttggaatactgtcacgttcccctcgagccatccaataaacaggaacatttaatatttcacttgcgtgatcgcagtggtgagcgagatcgtcaatataacaaattacgttatatttttcttttgcctttttgaacaactcttcttttgaagaatcatgaccacacatcagtacttctgagaaggcaccaggaaaaagagcattcaaattaaattgacgattcagcagagcgtcaatagaatcacccaatgctgtaacagctacaaaattataatcttcttttaatttgttaattacacacagggcatctttatatggagacaagtatcgaataaaatccgaacgattgtatttttcaattagcttaacgccaagttcttcatcgcaattaaatagtttaccaggagaaataaatttctcatcctggatcatttttaaaatatgttctaacggaagattatatttctgagcaaaataaggaaggcctgattgccagcttaaacatactccatcaatatcagttaaaatagtaggcttcatagagagtctcttaataggtttaacacatcaataaattcagcttcggttagtattgtatcatcttttgttagaccactagccatgctgtgcttcaaaacttttcctttcgaggcttgtaatgcatcacggaagcccttgttttggatcgctgcttcaaaatatgcatttgtgtataattctttccacgccggggagtatcttgaaaatggaactccaagccagaagaggggtcccacggtcctgagctcttgcataagaccttccagcttgttgggcggcaagcccggataacccaaatatacgacgttgttgttcaacatttttcactttgcatccttggaggaatccttcaagacctccaaattgaatgccatccataacgaaaggccaatgggcgaaattacttaatgcgcatgatggccatctaaaattgcttctaatctctaactcagacattttcaatacttataatttcaacatcagcccaatgaccatagcaaggaagacgaaattcaactggccagttagggtccttttctaatataatagacttaacttgtggttcttcgtgttcatcagtatatggatttttatctgttactttatatgtgaccttaatgtactgaattccaaaaatcttattaattatattcatactatttcctttaatccgtagataggagataattcatcacccatacgaaggtcttcatttccatctacccagaaaacaatataagcctcttttatttgaataccactccatttaaacggaggtagaaccttagaaattaatccaggtataccaactccctttaattcaacagtttgacctaaaaagaatttcattaaaacctcatctgaaaaccgtgcgatttaacattaccgccattaatatcagaactattaatttcacgtgcaattgagggatcaatgtcaatttcgcgattgagtttagtgatagctaaagtatcgcgcccatttacagtacggaactctaaagggcagactacattaacgtagtttttaatcgattcactggtaggttgcaaatgtgcaggaaggtctttaggcgcctttgagaaaactacttcgcagaagtttttacgggtatcaaaataagtagtcataaacataacattttcctcagtaaggggccaaagcccctcatttattttaaatatcaaattcgttaagaactacatcaaagattgcttcaagatgctcaggtttagctctgttactcagaatatgacgaatccaagttttaaccaaaagcttgcgattaacgccattccagcaaggatgagtccctaaatcgcgttcacggaaatcatcatccagagcgattttaaagttggaaccttccatcgtgattgaaaccgtgataccgttttcaaatcgcatataaacgtaattaggagtcatatactgctcaatttcgcatactgatccattttgatgtttccaaaggcaaatagtatcaatagaacctgcaataccgttagaaacattagaaacatatttacgttcaaagttgatgtagttcattttattctccaagatgtttaattgcggtacaggtatataatatcatatcctgtaccaaagtaaacaattattttactactttccaatgctgcatgtcaagtttaccaacttttttcatcttctcaattaagcgttcggcacgttggcgagctgtaacataataccattcacctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagttttaactgcagcgttcagattaatcgttttcattttattctcctttgtttgtgtaagataatactatcacaaaggaaccatactgtaaacaactttatgcaatctttggaaaataaaaaaggactcccgaaggagtcctcaacttatgctttctgcttaccaaaacgagaagcatcatctcgaagaaccgcacgtgctcgacgcatgatcttctcaacagtttgattgatacgagagttcgacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggttttggatatttaacgacaggataaccataaacccgtcatcataccttatagctcttatctgttgcacaccgttagcttaaaggttccgggttcgatttctcgaggataagatatatactgatggatatataggccttgaggcgtactcccgattggccatcacctcggggtagcatgcacttgccgctataagaataacattcaagaggtacaccgtaaaactgccggggtcttaaaactataatgattcgcaaatcattaatcagacagttcgacggctcctcgttttaacttcacactaaggcagtgactctccaataaattacttcagtgttaccacaaagtgacgaactgcttttcgtgcagcagaagccagaggcttagcatatttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgaaactcaattcatattattatttatatcacttataaagacacggaatagctttatagtgacaggtaacaaatttttgtttaatttcttttggctgcttaagacccagagctacaaaaggatgcggaacatttcgaatttgaccaactggaagagaagtcaaatcaccaacttcacagaaaccttcaggaacatcaggaccgacagagtgaactacacacagttcaggaacttcaccttgaacacgtttaccgataataagtcctgattctgtaacttcttcatcaccggcttgtgcaggttcagaaactaaaataacatattcaccgacagcacgaattggtagctgttgtacttcagacatcgtttttcctttttgttaacagatgaattaataataacaaataattcttaaagcatttatttaccaataaattggagcaaatgctcaactttcataccattaacggaaatcaatttgtcaatagaaaaacctcgccatgcaccaagttcaacatcaaatactggaatcatatcagtagattctttccgagtagattcagtcaatttaccagtttgcatggttggcataaagtcagcatcgcgagtacctttcataacacgaatagtaccatcagacttttcaaaaactacgtttgaaacacccatggacaatttagttttcaaaatttcacgaattgctactttttgttcagtcgtcagtttcatttatttacctattacagttttaatatgagttgttccacgttctttaagagtggaaagtaatttttggcatttttctaaatcagatttccaactatgtggtctatcaatacaaacccagtttgacttataatactgcttccatttagagaaaaaatacttcttatactctacagcaaatgaaatgttctcgttggaataagaactaattgctgtgagctgtaccaaacgaaatttcattattcaccacagaattcgttgatattttcccagtttaacttatttaagtttttcttaggaacattaaacacttcaatacctgcatttcgcagaatatcatcccagccaggtttatttttatcgtatgtttcacaataaaccagctttttaattccagattgagctattgcttttgcacaatctgggcaaggagaaagtgttacatacatagtagcaccttcaattgaagaaccgtttcgtgcagcaaacaaaatcgcatttagttcagcatgaatttcatttttagacgaccattcagagtgcgcgctacgatgttctttcgccaatacaaaacgatcagttgaaccaaacgatacacattcaggcttatgaccttgaatgatagtatgtttaggcttattcagcaaccaaccttgctcagcagcataatcacagcagttcacaccacctgcaggtgaaccattatatccagtagaaataatacgtccattcttttcaattactgctcctactttccaggagcaacattttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcgccaaccatctttttgtgaagctcaactggatacttcgtcacaataatagcatcatacacagaaggatgaatactattcactagagtatcattcattaaagttattctaatgaactttgctgtttcagaatcaagcgctctatgatcgccagtatcattttcaagacaattatcaattatatcagttaaattcatcatagtacgccatacaccctttgtgcttcaactaatccatcgaaatccagtttaagatgcgatatttgatcgccatcacctggattcacaattactaatactgaacgaggagtttcggtaataacacgaaccgatgtttcgggaaatcgttcagaaaccttatttactaattcctgcgcaaatagtttaactttttcttggaattctttaacagtaattggtttttcacttagcatgttgatcccagctccttactttcaacgtttttaactaatttgacagaaactaattcagcatcttgggtaatcattaccgggccttcttcatgctcttcaagatattctagagctttctttttatcttcttccttcgtatcagtttgagcatagatatagaacatacaaccagtaatacctactactttccacttaatttctttatcagttttaatttcaaatttacttacagaatcatctttttgaacttcttcgaaaaaagaatattctaacatataagcaattgaaaataacgggctaactttataggattcacccattacatcaacagctttataccaacaatcatcaatttcgcgtttaatgctaataacatttttcgcaggatctatttttactttaaatgaattttccccaataaactgggcaattcgtttattagccccgcaagtttcattaaaaatatctttatacccagttttaaagcgataaaccttatcttcttcaaaccattcgctcatttcaatttcctcgtttgttttggtagagctataatatcacaactctaccgtaaagtaaactttaaattgctttgaattctgatgtctgtgattcaaagcgaatatcgcctttgatgactagctcagcatcaagaccgaatacgacaatgatatgcgcggaacctggatacaacgtgatggcaacagaatccacctggtctggaagcaaagtgttcaatacatgagtcacttgagcatggattcgaagctcagctgcgttatcaagtttttcaaacatattattagcgataatttggctaaacactacttctacgattttagagtaagtcggaaacatatttacctcacataattttcttcaagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccgactaaaccgctatttacaataacaatagcccaagtttcatggtgccaagccattaaaaatctcccgaagcgacttgccagcattcaacaccgatgcggcgccacatttcaactacttgagttcggtcatcaatagctaatttcacatcaaaatgtggtgcgatgtgtttccagaaaatttcttctttaactacatcatctttacgggtatcgccttgttcgcgttgacactgcatgactaatggaacaccagcaatgtcctcaacccatttacgggtcatacgataatatttcgttggatcttcttcggttccactttcacggcctgaaacgactacgatttgataacccataagagcatacatcttggatagttcaacgaccattggattaataatatcggtatcgcatttttcaaggtcataaggaccacgaccattcatttttgctaacgtgccatcaacatcaaaaataactgcttttggtttaccaggagtccctttatataccggaagaccgagatactctcgcatgcttttatacattgaacgtaaaacatcaattggtactgctttagttccgcgttttgagttgcgtttaaccaattcagtccaaggaacatcaaacactttatgttcaatttgatgcccaagctctttggcaaactcttcccaaaccttacgtcgttcaggattcagattagtatctgaaacaattacacccttcgttgcgtcttggcagagaatcatgttagcaacatcatgctgcatgtaagttacgataccttctttatttttggtatacttgtactcatcgcgttcttcatgacccatgatggattgacgataatcatcacgattaatattataaaaccctggatttttagcaataaattcgcgagcccaagtactcttaccagaaccaggacagccaatagtcaaaataatctttttcatcatttaattcctaagaaaacttcaagaatacgaatattgtgctcacaccgtcctttgtacaattcagctgttgattgattcgctgatttactctgaacattggatgaaataaattttatcatgtgatttttaagctgatacatatcaagcccacgagctttcgcttcttttcgcagggctttaccagcatcatctaaagctttagcagggtcttcatcatttaatactattccacgatccaaatccatgtatactgcaccatgacatgcatcaatgtaacggtctgagcattcaatataacgttctagcagagttttcatttatttttctcaaccaatgattgaatataatcatgcaggtctttagatgctttgccccacttattttggtattcatttttaagattagcacgtgattgagctaataaaacatcattagttggaggtaaagattctaatcgctgaatctggcgtccataaatcattgcagccatctcggattcataaatcaatcctttgagatgttcaaattgatgccatgaaatcatttacatttatcctcttttaactcttgacgataataacatatcatagttttctggtcgtgtacatatcgttttacatcattaagccaaatacgaaattcctgagaatcttcaaatggcataccgacccaagctttaccatcaataactttaacttgccaagataatttagcttcgtcatatgactttatttgtacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttacgagccaccacatccgccttctttgcatctttgcgcagtttttcattttcacgctcaatagcagcaatcgcctcacgatttttattattcatcgcatcaatataattatactgaattcgcaaattatttaatgctaaggcgttttcattggccgtttttgtaatttctacaacagacgtttctaatctttcaattttattttttaaaattaaagaagttccgcctaatgcaattacaattaatagcaaacctgctgtcgtattacttaattgcataaagttttaataacctctataatatcgtcttgagaaagaccgttaattaaaatatgatgttcagccggagatttagaaattttaaagcacgccgcaacatcttctgccatatccgatgcgctacgatttggattactaattccaagacgatgttttcccgttaaaggattaacgatgatatagcatttacagttgttaatatgaacattaggttgagtctgattaatgaacacatcgcaatcatatttcgcaagctgattttctaaaaagactttcatctcctcaaccgcatcaggaagcatatcacgggcttgctcaagacgacgatttcgatattctttaatggtcgttttccgcttgacttgcttagctaaatctttcttaagatcggtgatatatccaactcgacgatttcctttaaatacagaaatcccatctgtagtatcaccgtatgcttcaacgaccatttcagtagtaataagctgcaaatccatcataaagtcctcatgttatgtcagtaagactactataacacaacacgagggacttgtaaacagcttagtatccttctgggataaattttttataatttttcaaaaaattctgttcgatttcgcacatgaccttttcttgactatcgtacccctgatataggctcataatgataccgaacaggtgatccattccagcacctttagcaacgccttgcgcttccatcgcataagtctttctatctttaccgcaatgcttattgtgacagtcaagaactaaaaacagagctcggtctaagtacttcagataagtcgtctcaaatgcttcaatttttctatatgaatattcatcgtcagcgtacattgctttaagatcatctgatgcaccatcaataatagtcttaaacaatttttctggattatctaatgaactttttgtactatgaagagacacgtaccaatcagacttaattttaaaatgagaaccatctttcatcacggcaacatagccttcgatgttttctgcatttttagcttcttctacccatttagggctatcgatttcgaatcgttcaactagatatggacgaagagcagcatctttataaatatcatcgtatgaaatgtattcacccgtttcgttttcacgaacattcagtaaaataattttcatttcttggtaagcaagaacgattctattcgtcggagcaacgaattcgaagttagcagtaaatccatcttcagctaattctttaagtctatcgcgcaaccgatggtgattaatattcatcaaaatcccattagccattaaagcctgctcagatttgattgaaccctttgatttgaacagaatttcatcaccatctaaataagttgataccaaagacccgtcttcttttgttagaatgtaatcaacatcatttaaatcgatattcatcgtgaatggattttcattcaagttaaaaaacttttccataggacgagaagcgattcttaccggtttttctccatccatttcaaacataattccacgacattctaatgcgtctggaagtaaccaatcagaataagatgcataattatatgagaaaattctgtaagttcttccagacgcacttacatcatccgagtaaaaaaacttacgctgtgaatccttacatagttccattaaattgttaaaaagttcttgcattgtgtatcctcttttgtgttttgaatatagtaccacactccatgtggaagcatcattttttcttgtgttgaatattccaaggcgggttaaacagtttaatgaatagcggctcctctaggtcaatcgttgcgattgtcattgtacctaactcatttgtcatagaaagattaaaacattggcgggcgtaaaattcaactttgcttccttcctttagcgcagaatgaattaatgcagatttagtagaatcagacgttttgtctttacgattaatagcagttctataatagtttattcttttacgtaaatttttagtttttccaatataaacaagctcatcatttatagcaatagcataaattacgttatacttgtttggaatagataattgttttatacttccgttgtcgtctaattctagctcagtatatttaataaatgaatattctgttgcaatttctttcataataaaatgggccttgcggcccactccttaaaagtattttttaaaactcatcataactttatcatcaacatcattatcaatctgtgcaacaagataagatgacagttctacttcttgtggcgctgattgaacattatcagaattaagatattcacgaatccaaggatatggatgtttaaccggagcatcggtaattgggcatggaagaccacactgtttcatacgagatacagttaagtaatcaataaagctccacatgctatttgtatttaatccaggaacatcgccatctttaaataaatgaactgcccaatctttttcttggcggttaacttccatgaaaatatcaactgcttcttgctcgcactcttgagcaattttaacccattcatcgccatcagtgccaagttgaagttgacgaataatatattgggtgcctttaaggtgaagctgctcatcacgagcaatgaacttcataatcttggcattaccttccatgatttccatgttcttatggaagttaaaggtacatgcgaaagatacataaaaacgaatagcttctaaggcattaataacgtgcaaacagaggtaaagagatttcattaactcacgcttccaatatgtctcatgctcaatagcatcttcaataacgtcttcgtctgcattaatttctttttggtattcgatatcagctttagcgttttcccaataacgagttttaatcagaacatcatcataataacgtccaatggattcagcacgtttcataatagcttcatctaatacaatctcatcaaatacctttgacggatcagtataaagatttcgcatgatatgagtgtatgaacgactgtgaatagtttcactaaaagtccatgtagcaacccatgtatcaaggcttgggtctgaaattaatgacataagtacagcagacggcgcacgaccctgaatgctatccaaaagtgattgatacttcaagttgttagtaaaaatattttgctgatactgaggaagcttattaaactgtgcagcatccatcattaagtttacttcttccgggcgccagaaaaatgataaggacttttctgtaagttcttcaaatactcgatgccgttgaatatcataacgcgcaataccaagacctgaaccaaaaaacataggttcttttaaaacatcaactggatttgtattaaaaactgtgctcataaattttccgcttagttaatagttggtgactcgtccgtgagtcaaattatatcataatttacaggatgaacaatcttcagcttttggagtttctatttcataatcatcagtaccagaaccatcacgggtattatgataatagaaatttttaatgccataataccatccgtatagcatgtcatcaatcattattgacattggaacctttccttttggaaaaatctgcgggtcatagtatgtattcgctgaagctgattgacatacccatttcagcataatagctacctgcgtaagataaggtttattacctttcttagctaatttccacgtataatcatataggtctatgttatgctcaatattgggcacgacttgattaaaggagccctcttttgattctttaacagagactggtccacgtggaggctcgataccgtttgtactgttagaaacttgggaagatgactcacatggcataagtgctgataatgtgctattacggatgccaaagagcttaaggtcttcccgcagcgccgaccagtcacaaacgtattttggagctgcgatttggtcaatctttttattgtaccagtcgataggtaattcgcctcgagaccaacgagtgtctgaataatattcgcaaggtcctttttctttggcgagcttaatggatgctttaatgagcccatactgtaatctctcaaatagttcatgtgttaaatcgttagcatcttcataagaagcaaagttacttgccagccaagctgcatagttggtaacacctacaccgaggttacgacgctttttagctttttctgcttcaggaactggatatccttggtaatccaacagattatcaagagcacgaacttgaacttctgccaattcattaattttatcttggtcttgccagtcaaaattatctagtacgaatgcagagagagtacacaatccaatttcagcatcaggactattcacatcatttgttggaatagcaatttcacagcacaagttactctgacgaataggtgccttttcacgaataaacggagtatagttattcgtattatcaatgaactgtacataaattcttgctgttcctgagcgttcagtcatgagcaattcaaatagttcacgggctttaatacgctttttacgaatattagggtctttttctgctgcttcgtataattcacggaaacggtcttggtctttaaaataagaataataaagctctccgcccatttcatggggactgaacaaagtaatgtaatcgttctttccaaaacgttccatcatcaaatcattcagttgaacaccataatccatatgacgaatgcggttttcttctacgcctttgttatttttcaaaacaagaagattttcaacttccaaatgccaaataggataataagcagtagcagcgccgccacgaattccaccctgtgagcatgatttaacagcagtctgaaaatgtttccaaaaaggaataacaccagtatggcgtacttcacccatgccaatcttagaaccttcagcacgaatcataccaacgttaataccaattccagcgcgtttagagatatattcaacaattgaagcagaagccttattgatagacttcagtgaatcgcctgcctcaataacaacgcatgaactaaactgccgagttggagtacggcaaccagccataataggagttggtaatgaaatctgtcgagtagataccgcttcataaaaacggataacatgttttaatctatcaacaggttcatcttgatgcaatgccattccaatagtcataaatgcaaactgtggagtttcataaatttgaccagtggttttatctttaactagatatttttcttttaattgcatcgccccggaataagtaaattccatatcccgctcgtgcttaatttttgattctaaaaatgtaatttcttctgctgaatattttgacaataattcagggtcatatttaccttcatttacacagtaagaaatatggtcaataaatgaacgtggttcatactgcccataaacatgcttacgaagagcaaacattaaacagcgtgcagctacatattgataatcaggttcttcaaccgaaatagaattcgcagcggccttaatgacaatagtctgaatgtcatcagttgtcattccatcacggagatatgatttaatattttcatataattcataaggatctactgatgttccctcagatgcccaagataaaactttaataattttttgcgggtcaaagctctgagaaacaccactacttttgataacattaattaattgcataagtcctcaacttgaaaatcgtctttaaacagtcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccgacatagacggcccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctaactcacttgggttaggaagtgtaaaaagaactacaccagaagtatctttaaatcgtaaaatcataaatcctcacaattaaattaaaattacaccgccatttttcctttcaagacgccgtgggactgataatctttgagaacgaaatctttaggcctgagtttaagaatgtattccaattgttctttagtagaaagatagcggaatttataaggcaatccgcctattaccagttcacaaagctctttaggttcacgacgcaaaatttctttacattgttctacgtgattcatatagatatgagtattaccaccggaaaatatcaaatctcccggaataagattacacatcttagctacaatatgaactaacgtagcatatgatgcaatattaaatggaagcattatgttcagataaggtcgttaatcttaccccggaattatatccagctgcatgtcaccatgcagatcagactatatctccaacttgttaaagcaagttgtctatcgtttcgagtcacttgaccctactccccaaagggatagtcgttaggcatttatgtagaaccaattccatttatcagattttacacgataagtaactaatccagacgaaattttaaaatgtctagctgcatctgctgcacaatcaaaaataaccccatcacatgaaatctttttaatattactaggctttttacctttcatcttttctgatattttagatttagttatgtctgaatgcttatgattaaagaatgaattattttcacctgaacgatttctgcatttactacaagtataaacagaagtttgtatgcgaacaccgcacttacaaaacttatgggtttctggattccaacgcccgtttttacttccgggtttactgtaaagagctttccgaccatcaggtccaagtttaagcatcttagctttaacagtttcagaacgtttcttaataatttcttcttttaatggatgcgtagaacatgtatcaccaaacgttgcatcagcaatattgtatccattaattttagaattaagctctttaatccaaaaattttctcgttcaataatcaaatctttctcatatggaatttcttccaaaatagaacattcaaacacattaccatgtttgttaaaagacctctgaagctttatagaagaatggcatcctttttctaaatctttaaaatgcctcttccatctcttttcaaaatctttagcacttcctacatatactttattgtttaaagtatttttaatctgataaattccgcttttcataaatacctctttaaatatagaagtatttattaaagggcagtcctacaatttagcacgggattgtctactagagaggttccccgtttagatagattacaagtataagtcaccttatactcaggcctcaattaacccaagaaaacatctactgatcgttgataccactgcaaatccaaatagccattacgcacattaaactgatagaacatatgacaaggcggtaatgccatctgcttgagttcagctggattccatgctgaaacaatttgacgcctatcatttggcaattttttaatacgatcaataacttctataatttggtctacaccaccaaaatcacgccactgttttccataaattggaccaagttcaccgctatggtatcctaaatcttttgcttgattttcgtaattttcatcccaaactgttttgccttggattaacgaatcatgttgaattaatcgcaaatcattgacatttgtgcttcccgataaaaaccaaagcagctcagcaatgcaagctttccaggcgagcttcttagttgttactgcaggaaaacctttagttaaatcccagcgtaatttagtaccgaacaaagcaattgttcctgtgcctgttcggtcatcggtttcgtagccattttccaggatatctttaattaaaaattggtattgtttcattagttcatccaagaatatgtagaaggatatttggcaaaattaggcttatatcctaatttaaccatttgttttgctttgcgagtaaatcctaaagaacgctcacctttaagatattgttttggtgtcataggcccttgatgcatctgccgacaaataaaaagggccatagcattaggaacatccttaacttttaatttattgctcatttatatactgattccgtaagggttgttacttcatctattttataccaatgcgtttcaaccatttcacgcttgcttatatcatcaagaaaacttgcatctaattgaaccgttgaattaacacgatgccttttaacgatgcgagaaacaactacttcatccgcataaggtaacgcagcatataacagagaaggtccgccaattacactaacattagaattctggtcaagcatagtctcgaatggcgcgttatgacttgaaacttgaatttcaccaccagaaatgtaagttatatactgttcccaagtaatatagaaatgtgctaaatcgccgtctttagttacaggataatcacgcgcaaggtcacacaccacaatatggctacgtccaggaagtaatgtagataatgactggaacgttttagcacccataatcataattgtaccttcggtacgagttttaaaattctggaggtcctttttaactcgtccccatggtaaaccatcacctaaaccgaatgctaattcattaaagccttcgacggttttagttggagaataagcgaataccaatttaatcattacgcaaagcccctttcaataaaccattcagtggctttattagcgtcaaagaataattcttcatatgtcttttctttgttttcaaagactgtcacacaaacacgttgacattctccacagtattcttctgacatactcaaagcgtcagaaaacatttcattaaattcatttaaatcaggattatgcaatgcgttaaaaattgcataatcgaattcatcattcataaattcaaatacaaaaatcatattattttccttaaacagactttttcacaattttccaatcagctttaaactgctcgacgtcagaatggtaaatccagaatcctgcgctttcaccgtcttcataaagcggacacccatcacattcatcttcccatcccatgccacgtaaaaggtgttcagctttttcaacaagttcagaatctttaccgatgatattaaaataccatttacctctaacttctgaatctttgatgctctggcgttgtaatctcattttattctccttagcaagctttaatcaaaagatataaacagaccaacataactgctgccataatataaggtgcgaacattttcttttctccattagttttgatagggtaatagtatcacactactacccttctgtaaactactttttgaaagtttttcgcaaaagttcaatgatttcatctacattgttttcgtcaacaatgcagtgaatttttgttacgccagaaactttgtctttgacttcatcttcttcagaagtcggttctttatactcacgaaaacaatgaaattcgtcttcacaaacgttaaagtaaaaatgctttccatttgcgcattcaatgtgttttattactctaaatccatcaacaaagaaagcttctttaacttcaaaccatccgccattttcttgaataattttaactattgctgaattagaacgtgggcgataattaataaatgtatcaataagtcttggaacaagttcatactttttaccgatatacattatgttttcctcattttaacggggctgtaatagccccttgataattattgttcaatcaatcccatgtaaaattctgcgtcttcagaatccataccatcacaatattcattagccataaagcgggtgaggtcttcaagaggaccttcaataacgatttgaatactccaaaacttagaatcttgcacgcttgtgatactaagttcaggataacgattacgaataatttcttcgatatattcaaaatcaacgatgtcaatatcaactttagccatattattttcctctttaatcatcagcagtattgccgatagttgtatagtaccatggaaggacaaggatgtaaaccgttttgtgaaaaaatttttgaaataaaaaggggacctctagggtccccaattaattagtaatataatctattaaaggtcattcaaaaggtcatctaggtccgtgtcatcagcactagatgaactgccagagcttgagctcataaaatcatcttcagtttttgtattgaagtcatcaacattgaatgcatccaaatcatcagcaactttatcagctttcttagcagcagttgcagcagcaccgcccatcacagcagttcccataacttgaccgaatttagtgctcagttcttcaaacgatttgaatttatctttagaagtcatttcagaaaggtcaaccatttgttcgaacagttctttctggaaagattcatcgtcaatgtttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttacaacaagaatattagcccagtaagaagttttacgtttaacaagactgtactctttattgtcagtgttgtacagatcatttttactgatgtactgacatactggacaagaatcgtaatcaccatgggtagatgaacatgtttcaatataccatttaccatttttcttgaaaccgtgatttacaagaattgcgaatggtgcttgttcatcatttttagacggaagaaaacgaattactgcttgaccgttacccgcattatcgagtttcagtttccactcgcctttatcttcagaagaaaaacctttattgccattcagtttagccatttgtgcagcaagttcagcagtagatttacgtttaaacattttatttcctttttaatttaatttaatttaattaacagttggtgctatgacactttacctcatagctggcataattcgcaatactctgggtcttcgagaggtatccaacctgagttgaaatactttaccatcgatttagcagttgtatcagttatatttatattacctttaactcttcgccatccaggagttttaccgtacagattagaggataataataacacataattctcgtaagcaatatgagataatttccaagactctatattagctcgtgatgttttccaaggtctaaaatcgtcacggttcatataattagccaatctcatatgctctctaacttccgggtctttggctggatgagtttcaccactcacaccaaatccaccaccagcatataccagattaaaatagtctggattatctctggcatttacttcaagttggtattttcgttctgcttcaataacatccaagtcatcatcaatttgaattattttaacgctcggtttttgaagcattagcgcattcaaaaatcttttttgtttacatgagctccagtattcctttccggaagagtcatatattattccgttctcaaatgagcaatttaatttactaccgatataatagtatggcggagtcttatttttgacacggtcttcaaatgtaaaccaatatactatattcatatcaatacttacaagatttcacagtttcaataaaaacttttttagcttcctgtgaatcgatatttaaaatttttctataagcttttaactttatagaataattgttccagactaaattatcagtctgttcatcatgtttatcaattatatttaaaaacgaatcaagcaagataaacgtttcaaacgaaattatattcgattgaagtagtttaaaaatataacttgattgaacttttggattatactcaaagatttctttaaaagcagaaacttcaactttcttactaaaataataaatgttgcgaatatcttcttcaaacttaaatttaatttgctttaagcgtccgatatattcacgataaaacacaagtgcatcagcgtcagagatgtcgccaatccaagcatcctggttagcaacaagattgcttataaagattaaagcaagttcctttaatttatatttttctgataacttctggaaaaaatacttatcccttcgcttttgataagcggcatcagacacccgcatgcaccaattatacttaataacatcatactttccattcatatgttgttttatcattaagtataatttataaactgatttaccatcaatgtatctttcaccaccagcaggcatgcggagtttaatcatagtagaaaatctaatgtattagttttttcacaacgaacaacagaaggacgtaaaagattttcgtcaatggcttctgactgaattttttcaattatacccgaaggaataaatttagcaaattgagtttcaggaatagagttttcttctaagaatgctgttgtagcttcaagataactcattccaaactcttctaccattttttcaataataaatccattttcttgacgatcaagaagctttgctatttcatccttttctttcttgattgaaagttctttttctgaaagaccggtctcatcgaccggacgaatgtcatttagagaaaactgtgtcataaagttcaactacctcttcagtttcagcttcaaacacatcacggttatctttatgatacaaagctaatagacgattaaacatcttaccatcaacgccaagttcatctttggcacgaattcgaatatctttaatcaattcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatactcagattctgagagaagcaccttagcttgctcacggtcattagcaatagcttcaacgattgaagttttcattgaaggagttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttatgcatcggtgaccattgcttaacatttggatatttgtgaagctgtgtaaagtcaccatccgacgaaatgattaaaatcttgtgtccttctaaagagaactttttaacaagaacagcaatatggtcatctgcttcatacttatcaatatccataacaatgtatggcatataagctttcaattcatctataactttatggctggattcaaaataaccttcccagtcccaagtagattcttctcgtgcttttccacggtttttcttataataataagcaaaatcacgacgccagtatccagatttcgcgttatcaatacacagcacaattttagtgtatccaagcgtttttgcttttttgacattaaacttaattgagttcaatatcaaatgacgaaccattgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgatcgtaccgtaggaactgacggtgttaacgttgattacttaattcaagaaaacacagttcagcaatatgacccaactcgtggatatttaaaagattttgtaatcatttataataatcgtttttgggcagcaacggataatattccaaaacctgctggaaattttaatagaattcgttggaaagcattacgtactgatgccgtatatacaaccgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatggtattcatttttaataatcgtttgtggcaaatgtatattgctgattatagcagagaagctgcgattgttactccatcgactgcatatcaagcacaatctaatgattttatcgtacgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaaggccgtacatcgattgacggtttcttgatgtttgacgataatgagaaattgtggagattgtttaacggggatagtaaagcacgtttacgcattataacaactaattcaaatattcgtccaaatgaagaagtcatggtatttggcgcgaataatggaacagcccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaacggtgaaactaattatgtaccagttttgcaacttgcttatatagaagattctgatggaaaatactgggttgtacagcaaaacgttccaacagttgaaagagtcgattctttaaataattctactagagcaagattaggcgtaattgctttagctacacaagctcaagcaaatgctgatttagaaaattctccgcaaaaagaattggcaattactccagaaacgttagctaatcgtactgctacagaaactcgcagaggtattgcaagaatagcaactactgctcaagtgaatcagaacaccacattctcttttgcagatgaccttatcatcactcctaaaaagctgaatgaaagaactgctacagaaactcgcagaggtgtcgctgaaattgctacgcagcaggaaactaatacaggtactgatgatactacaatcatcactcctaaaaagcttcaagctcgtcaaggttctgaaacattatcgggtattgtaacttttgtatctaccgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacgccagaaacgttacataaaaagacatcaactgatggaagaattggtttaattgaaattgctacgcaaagtgaagttaatacaggaactgactatactcgtgcagtcactcctaaaactttaaatgaccgtagagcaactgaaagtttaagtggtatagctgaaattgctacacaggttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttaataactcctaaaaagcttttaggtactaaatctaccgaatcgcaagaaggtgttattaaagttgcaactcagtctgaaactgtgactggaacgtcagcaaatactgctgtatctccaaaaaatttaaaatggattgtgcagagtgaaccaacttgggcagcaactactctgataagagggtttgttaaaacttcttctggttcattaacgtttgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgagtgcccctcttgtatcatctagtactgctacattcggtggatcagtttcagcaaatagtacattaactatttctaatactggaacggcaactcgtctgatttttgagaaaggacctcaaactggaacaaacccagctcaaacgatgacagtcagagtgtggggaaatcagtttagtggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattagcggaaattatggtttcattgttcgcaatgacgggtcagtaacgaattttatgcttactgcatcgggtgatcaaactggcggatttaatggattgcgtcctttagctattaataatgcatctggccaagtaacgattggtgaaagcttaatcattgcaaaaggtgctactataagttcgggtggtttgactgttaactcgagaattcgttctcagggtactaaaacctctgatttatatacccgtgcgccaacatctgatacagtaggattctggtcaatcgatattaatgattcagccacttataaccagttcccgggttattttaaaatggttgaaaaaactaatgaagtgactggacttccatacttagaacgtggtgaagaagttaaatctcctggtacattgactcagtttggtaacacacttgattcactttaccaagattggattacttatccaacgaccccagaagcacgtaccactcgctggacacgtacatggcagaaaaccaaaaactcttggtcaagttttgttcaggtatttgacggaggtaaccctcctcaaccttcagatataggagcgatcccatctgataatggaataataggtaatcttactattcgcgatttcttgcgaattggtaatgttcgcattattcctgacccagtgaataaaactgttaaatttgaatgggttgaataagaggtattatggaaaaatttatggcagagtttggacaaggatatgtccaaacgccatttttatcggaaagcaattcagtaagatataaaataagcatagcgggttcttgcccgctttctaccgcaggaccgtatgttaaatttcaggataatcccgttggaaatcaaacatttagtgcaggtcttcatttaagagtttttgacccttctacgggagcattagttgatagtaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtgtcatatgctgctttttatacttcttctaaaagagctattgcattagagcatgttaaactaagtaatagaaaaagcacagatgattatcaaactattttagatgttgtatttgatagtttagaagacgtcggagctacaggatttcctaaaagaacatacgaaagcgttgagcaatttatgtctgcggttggaggaactaataatgaaattgcgcgattgccaacttcagctgctataagtaaactttctgactacaatttaattcctggtgatgttctttatcttaaagcacaactatatgctgatgctgatttacttgatcttggaactacaaatatatctattcgtttttatgatgcatcaaatggatatatttcctcgacccaagctgagtttactgggcaagctgggtcttgggaattaaaagaagattatgtagttgttcctgaaaatgcagtaggatttacgatatatgcacaaagaactgctcaagcaggtcaaggcggcatgagaaatttaagtttttctgaagtatcaagaaatggcggcatttcaaaacctgccgaatttggcgtcaacggtattcgcgttaattatgtctgtgaatcggcttcacctccagatataatggtacttcctacacaagcctcttctaaaactggcaaagtgtttggacaggaatttagagaagtttaaactgagggagccttcgggttccctttttctttataaataatattaaaataaaggggcatataatggctgatttaaaagtaggttcaactgtgggtggatctgtcatttggcatcaaggaaattttccattgaattcagccggtgacgatgtactctacaaatcatttaaaatatattcagaatataataaaccgcaggcagctgataacgatttcgtttctaaagctaatggtggtacttacaccggtccaattactattaattacggggtaaatagttatcttcaattaagtaataatgaaacccccatccgaattcgttctggtggcggcactggtaatactcttgtagttggtggctcttctggcggtattagttttagaccagcaggtagtgaaatcactactggacaaattacgattacgccagaaggtttgacaacatttaccaaagctgtaacggctccatctgtaactgttacatctactccttccgcagcatctgatgttactcgtaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaatgaaggattctgttcaagatttcggctattattaagaggacttatggctactttaaaacaaatacaatttaaaagaagcaaaactgcaggtcaacgtcctgctgcttcagtattagccgaaggtgaattggctataaacttaaaagataaaacaattttcacaaaagatgactcaggtagtgttatagaattaggtttaaaatatggaggaactataaatgggtctttagaggttacagaaaatataactggaactttaattggaaattctagcacagctactaaattgcaaacacctaggaaaattaatggtatatcttttgatgggtcaaaggacattaccttaactccatctgacataaatgtcaatagcacaacatttataaaaaataatggcgaattacctactgatgctaatttagatacgtatgggcccattgaagaatatcttggtgtttggtcgaaatctacttcaacaaatgcgcaaccagcaaataaattcccagaagaaaatgccgtaggtgtactagaagtatttgtggccggccaatttgctggcactcagcgttatactgtaagatctggtaacgtctatattcgttccttatctgctaaatggaatggcgtcgatggtccatggggtgtgtggcgtaatgttcaagcgtcaactcgtccactttcacaaacgattgaccttgatagcttgggagaattagaacattgtggcttatggagaaacagttcaagcgcaatcgcatcatttgatcgccattatccagaagaaggatcagccgcacaaggatttttagaaatatttgaaggtggtttatacacaagaacgcagcgttatactacccgcatgggtatggtttatactcgttgtctcgctgctgcatgggatgctagtgcacctaagtgggaggaatggaagcaggttggtcatggcacaccagcgactttctatgatggagatctgaatgattttaaaactcctgggttatataacattttaggcactgatgccgttattaactgtcctactggtgaaggtttaccagccgttattgttggtttgctggaagttaaacagcgtgcttctggtggtgctattttccaaaaatttactactgccggaacgggtgcaactactcgcgatcgtatttttgagcgtgcatatactggtggtgcgtggggtgcatggaacgaagtatatacatcttattctcttccaattactttgggtatgggtggtattaaagctcaattagcggagttagattggcaaacctttgattttgttcctggtagtatgtttagcgttcctttgaacaaaataaagaacatgccagcaaatatggattgggggacgattgacggaaacctggttatgttttccgttggtcctagtgaacacactagcacagggcgtactgttcaggtttggcgcggtactgtatcccagacaaactaccgttattttgtcgttcgtgtgttcggtaattctggaaatagaacttgcacagtccgccgtgttgttcttgaagatggtctccacacatggacagctcaacaagattttaatggtgctgttaacttcggtgctcctaccaattttaactctactgttaaccttaataacactaccacatttaaaacagaagttaaattccgctcatctaatgcattccgtatgtatggcggaaaatttggtacaattttccgtaatgatggagagagtctttatattctttccaccgacgaaaatgatcaagatggaaactttaatacaaatagacctttccgttatgaattaagaactggtgatgttactttgggtggtactagtggtgctaacgttttaaaattaaaacgcgattctctcaccgcattttttggtggtgatattaatataaaaggcttgatgacttttgatgccggacgtttaggatcacgagattattttaaatttaaccattggggtgatagtaataatgcgcgcgataacattattcagttagaagacagcaaaggcgttcatttttccactgaacgtactttagcgactggtgcaattaaaactaaattctttggtgaagttgaatccgaaggtagattgattattaaacgtccgggtgattctattgtattatcaacaactgctggtaatgctttgcatattcgtggtgacgtagacgggagtggtaactggtatattggtaagggtggtgctgataattcgctagcattttatagctatgctactcaggcggcagtacatatcacaaacaatggtgagatttcgctaaatccacaaaatatcgcaatggttaacgttaaccgcgatcgtgtacacattaacggttctggatggattgctagacaaccgggtgattggggcaaccaatggcgagtagaagctccattattcgtcgatcatggttatgtttcacaggattgttattatccaattattaaaggaaaaagtgtaatcaccaatcaagggtttgtaactgccgtcgatcttggtattcgtcgtgtccctaacaattgggggcaagcaattattcgtgttggatctgcagaggcatcgccagcgactggacaccctaacgcggtatttgaatttcattacgacggtactttctattctcctggtaatggtaactttaacgatgtgtatattcgttccgatggtcgtcttaagattaataaaaaagagctagaaaacggagcacttgaaaaagtatgccgactgaaagtttatatttacgataaggttaagtctattaaagaccgtagtgttattaaacgcgaagttggtattattgctcaggaccttgaaaaggaattaccggaagctgtgtctaaagttgaagttgatggttctgatgttctgacaatttctaactccgctgtaaatgctcttttaattaaggctatccaagaaatgagcgaagaaattaaagaattaaaaacgcctttcttcactaaaattgctcgcaaaattagtaattattttaaattctaacaacaaggggctttgcccctttggagataattatggcagtagttggtgttcccggttggattggaagttcatccgtaaatgaaacgggtcagcgctggatgagtcaagcggctggtcaattaagattgggtgttccttgctggatgagtcaatttgcaggtcgctcacgagaaattattcacacgcttggagcagaccataacttcaatggtcaatggttccgagatagatgttttgaggccggtagtgcacctatagtgtttaatattacaggtgatttagtatcatattctaaagatgttcctttattcttcatgtacggggatacgcctaatgaatatgttgttcttaatattcatggtggtgttcatatgtggggtcgtggtggtaatggtggatacactcactcgggaggcgacggtaacggtacacaaggcggtcatgttattcaaaatgatatcggtggacggcttcgtatttggaactacggtgttatagctgctggcggtggcggcggtggtggtattgcatatcgtccacactcaggggcaaactggcaagatatcggtggcggtggtggtcgacctttcggtggcgctggcggtggcggttattccggtggtgctgcttcgtatgaaggtccgggtggtggttatgactatggtaacgcacactccggcgcaggtggtaatgctggtgctgctggtcagaatgcatggtctgacggcggtaaagttcttaaagttggtgttggtggtgcgtctggtcatgcagtgtttgggtcttctccaacttggggtgctgttggaacaatttacggaccaagagtataatttgaataaatatccttaaaaggagggtctatggcagcacctagaatatcattttcgccctctgatattctgtttggtgttctagatcgcttgttcaaagataacgctaccgggaaagttcttgcttcccgggtagctgtcgtaattcttttgtttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcacatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacgataaccatgtactggtatagaaatgatcatataagtaatgaccgccttgaatcaatatgtgctcaggcggccagaatattaggaagggctaaataattatttgttcgtatacatttctagatatcgatatacaccctcaaaaccctcgttgaattcatcgatgagggttttcttatcttcttgagttaattcagaaacaattttacgaaatgaattctgatttaactttctaccttcatgcgttactccaatctcattaagaaatgcaataaaattagcacgattctcaacaatatcttctctggaaaatttaatcaaaatagatgcaacagtaataatttcacgaactgtatcaatgtttttattcattaactataccactcaattagttgactttgttataatatcatcagacgcttgatttgtaaactggtctgtgttattttcttcaaaaattttttctacgaattccttgaacgactcgcgttcctgagctacattatgctcgattaccttttcaagattatgactcattcgaaataatcttcaatttcgtaatcatggacataaatcattatagtttctaatacatcatcaatactttttcctggagctggaattacgtaaaaatatcctgcttttgagaggtctttataagttccaaccaagaaatcattattctcgagatgtaattcttcaactaattcattaacaattgaatggtataaatttggtagaaacttatatagcttttctagaatatcaattttgattgtatattgaaccacagattgagaatcaataatcatagaccttccccttatgtttctgtttgcgattagattctttaaacgctttcttcttatccttatgaacagaagctttattaaaattatgttttgcgactaaattgttcatagtgctgaattacctctctcaaacatttgcatgtgaatgaaaactttttagctacaccacattcaaatatatgttctcttaaatcacgtgtatcagtatatcccatctcaacaataaaatgccttattagatttttatctttatcattgagagaattaaaataatcagattttgaattaatttccctggccaaattgaatcaccttcagttgacgttttagctcttttatcatctcttcgttcatcgcaatataaagatcgcgtaaagcaggctttagcattccatttattggggaactaaatggacatacataatcttttcctacaagctttttggtaaattccatatcacaaaatttaaatgctggctcattcgtataaattccccaattagttgacatcattttattggcatattccagtgcttggatttgattagtaattccatcaatttgaaactttttaatattcattagtaaaggtcctcagagtaaagttctttttcactaccaccacgttcaatacgcacttgtccagcgtaagttgcaataatcattgcttcttcacgtgtccagtaattgctatactggtcaataaatccttggtcttcaccacaaacatggtctgatacaagtttatcacttacctggtcaagaacttcagccatatctttagaataatgacgagcaccaggaataaccagagtcccaccatcttttaatttaaaacggttggctgcacagacaattcgtcgttgatacttttgattttcatcccaatatgcagtctgccaacagatttcaggaacttcatctaaaacattttgttttgtatattcaccgccgtaagaagctaatttagcagccagactttctggagtctcacgtgacaaagctttatctaacagagctaaacgttctttaaaagttttcatttaaaccatcctttaatacgttgccacaaagttttctgttgagctttgttaacgccaattgagcgaataactggttgagattcctgaaattctttataatcagcaaggtaaatttcgtaagctgcatccgtaaaggaacttatcgctgccataaaattattgcgaatacctactggagcatctttactttcacgaataatcatgtatttaccagtcttaatctttacaatagttccaagataagccccatggtaccagatgtcccacccctcttgagtgggttctgcacaacgacgaagttcattaacaatttctaacttgttcattatttattcctcacagttcagatgctacggtgattacagcttcaatgttttctgccgagcgtttaatgtcaagatacacattaccatttttagcgattttacatgacattccgatatcagtaaatttctgaatatgatgttccatcattttgtatccaaaaattcgcatatttccattgttgttaatttcaaaattgcgaattccgtgagtgcgtttttctaaaatagcgagatagttactacgataagtttcaacctttttaagaacaaatccattttcatctaaaagttttaacatgaggtctttatcttcttccatatcagaagtaatctcacgagctttacgagttgctcgttttttcagtagttcaggagcattttcctgtgcatataaagttgccgcatttgaaataatatcctgagcttcaccagtaatgattaatccatcaccagatttctccaccaggccttttttaatcaataccccaatattactattaactactgcgttacctaaatctggatgcacctcacgaacttctgcagctgtaatgaaatctttcttagcaatggtaattaaaatcgcagcagttttttcattcagaacatcgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcatttttttttgtatctccgggttgtttgtttcagttcatttatttgatagttgtatagtaccacagtatgctttggttgtaaaccgttttgtgaaaaaaatttttgaaataaaaaagggagagccgaggctctccctaaaattactgcatgactgtgataactgtcatgataacacgttgaatgccgaacgcaagaagacctcctgctacggctggaacaacgcctagaccagctagcaaaacacctccagatactagcgctgcgcttgtaatacctatgaatggactcatttgatttcctctaaatctttagtgtattcagtaactacatcagtagttttccaatattcgttttcttcttttttggctttagcttcttcagcaagtttctttgcttcatcggaagtcatatgaaaaatattcattccaactagtttatcaacataagaagaatacatatcaattttagaaagttcttcggtcagttctttacgagttttaccctgcacaacgatttcacctgaaattactttcttaatgaaatgtgccttggcaaaagctaaacgaaaagctgactcagtttctttaattttattatcaattcgtttttggacataagttttacgaacttcaacaaagtctttaattaaatcgactacgttatcgtaaacttgtagttttcctttttcattaataaccgtaatattctgagaccgacgctcaatcaacccgaagtctttcataatttttgcatggcgttcttcttcattatcgctcaaagagtattcttttcggaatttaactttgaagccaaagccatgctcaccacaagcatcatcccatgtaatgaagcctttatcttcaagcgggtctaagattttactcacataagtttcacgatcatacttatacggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgcagtacagctttcttgacagaagaaacactatgaggaagaatgtaagttgcataaccagttgcaataccggaaacgccattaagaagaacagtaggaataataggcaaatagaaagcaggcggaatgtgttctttatcttgatgtactggagcatattcagtatctttatatacgttatagaaatttttacttacacgagcaaaaatataacgacttgctgctgccttttggacagtacgagaaccaaagtttccttgaccgtctaacagaggaaagttattattccaagtgttagccatcaaagcacctgcgtcttgcgcagagttttcaccatgatgatatccaaggtccgctacaccacctgcaatagaagcgagtttgtgaaacttatctttatttcctcgtgccaaatcaagagctcgagcaataacaaatcgttgaactggcttaaatccgtcaatcatgtttgggatagcacgattttcaaccgtgtacatagcataagccaatgcttcattatcaatgatactttttaaatcgcgattattcagttgcataaatttaccatactagtgaatgtagtgccataataacatcagaaatgaaaagcacgacttgaattaatccgaacattactccataatatagtgctaccaataaagtagcaagggctagtgaatagcccaagattttcttaatcattagtagataacaacacaaatgttaaatatgcacacataccctgagctaaagcttgcgaaaacacactgctggcatcaatacagatagttaaaacacatgctactatccaacaaataaatgaaataactcctaataattttgcgatattcatattttcctcactggcgtccgaagacgcctttagttttaagattattacgatagaactgcatcacgtgttcgttgtggaaattactcattaatacgcctgcaaaacgaatttaaaattatcagccaacatacggttcatttcttcaagtgtttgatactcagaatgatgattacgagtaaacgctaaagctaactgtccttttccaaatcccgtcgtcagaggtttcatcttagaagcaggcagataaaatactgtgtataccatattgttatttgcaatagtacgtgcaagctgagaccgacgttgacgaatatgacttagaactgcactgaatccttgcttagaacgctgattacctacataaaatcgtgcggacacgcacggattactaaatggacgaccatctaatttactcactaaaaagtaaaatccaggtttagataaaatatctttatgcggagttcccaaaaaccattcaccgcccttgattgtgccaataacagtagcgcctgcattattcagatcagtaacagtcatgtatttcatattaatttcctctaaattattttctactccaaggccgcatgaatacacgcggccattaaattaatcgtcgcagtcgacgctcaattcccaaaactcttctacggtataagtttcagtatcattttcaatacagaaacgttcattactgttatttgctaaagtagcgttaactgtcattttctcgctggtgctcttaagaggtgaaatacgaattaactgatcaccactatccaagcaaaaaatttcaccaacttttacatctttaaagattttcataattcacctcaaggagtataaaatccaaatgcagttgttgaccatcccatccaatatggaaaatttgcgccaatgtaaaacataagaatataaaaccaaccactcatcaaattcatcattttacaccattccaaattgtttcaaccacggattttaaaccattttgatgaatatccattccgactaccgtcatcaaataaattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaaacgtttaatacatcaatcattaaaacgattgggaatatactcaaaactattagtattataactacattccatatagctttaacaatctttttcattttctgttcctccgtagttgatagggtaatagtaccacggaagaacagtcttgtaaacaacttttttaaaaatattcgtaataaatgtgaataccaatcactactgccgaaacttgtgcaacccaccatgcacacgcaataagtacagaattcaaaattttcataataacctcatcacaaaagtaaatgttaaacaaattactggaatactaattaaccaaacaaaacaccaacataatgaactcatagttcaatctcaacgatttccaagtgtttttgttttattgcctttttaacacaatcatggactaaatatgaccatgaatcattatattctccattaactaatcgttggagatcttcacgtgatgataagtaaggttgatctgattcccattttgataaaaatactgcagtaaaaatatctccttcatctgtagttgaagtcgtaaatgcaataaattcaccggtaattttatgtttagcataataaaatttaaatttcatttttactcctccgtagctgatagttgtatagtaccacggtccttgtggtatgtaaactgttttgtgaaaatttttttaaatggaaagataccatccattgtagttgctttttcttacaaccttacgaaggtcttctctgtcaccgatgaacttcggagtgtactggataacacctggatgaatttctttagtgttgaatataattatacagtcagcgacttgatgatttagaatgggccctagatttattccagaaccgtatggatactctccgctgcatcctgttgttacagaaatccaacgtgagccagtttgatgtgtcttaacttctacacgaagcccacagtattttggatgtgctaaaacatcccacgcgtatgtatatggatcatcgacatcttcttgacctttattaacatacccgcttagccaatctgctacaaaaaactctgcgtatacagcaatacgacatctttcaataacttctgctttatcctggttcgggttttgttttaaagagtatcttgcagtatcagcaattttgaccttcatttcgctagtcaagtcactgttcgatagggtaaatgtcggaatctgaaatagtctctgtaaacccggattcgttttctgcatttagactttcctttttaccactgagataagcgttatatactttaagagtgccgtaataaattcggtcattttcatctaaagactcgcggtcaagttcatcgagctcctttttatccatgactataacatcattacagtaaagaaacccaagtttttcgtgaccaaactcaaatttattacagtacacaatattagcgtgatgatttccgtgcagtttaatctcttttatgtcggaatcaccgatattcatacaataaatcataatttttccttaaaacaaaagggccgaagccctttattttacttgaattgtgcaattcttttctctagacattcagcataagatttcattgagatgaactgtgaaagtagcagttcttgctcaactacactaactgttagaaactttgcgctttctaaaaatttactcagtgcattaattttaagcattaattgatcgtattcttcttttactcgtgcttgataacctaacataattttccttagttaagggccgaagcccttatttaaattgttcagtaacgtcttcaactacttcgtattggcaggtacgcattttagcgtcgttgtaatcaatcggaattgataccacatcgcgaggatgcactttaacttttacgactcggctggttgaactgccaaagtgacgaatataagatttagaacacacatgcagaccacgagaacaagtttgtgtatcatcgtcattcacacgagtacgtggcattttaactactttacctggactgttatcaaaggtatttgagtgacagtcaaagtaattgctgcgaactactttccaagcatagaagtagccatcttctgtaatttcaatatcgtttgctaccaagaaatcaaagagtcgagataccgctttttggcttgggttttccagcagattttccaagaacggaaaataaaattcaaagttttcgcctttttccatcgagtcaagaatacgatcaaccaaaccagatcgcaattcaatattttgatagaacaagcttccaccttcaattcgaacatcgccggaaatatatttttcaacagcgcgacgaacattaattttttgtgctgcttcttccagcttatccgctacaagcagattaagaatttcctggaagtttgaatgagtattaggagttgcgttataagttacaccgtcaacagtaattgaaatgaattttttagatgcattccaaataatgtcagatttagcaactggagcaataactgcatcgctattaactttaactgtaatatcaccactaatagtaactttagggcgtttagcttcttcggcatttttcaaaacacgacggattgtgtcaaccgatacaccttgccaatcagccaattcctgttgggtataattaccgcttgaatacagtttaacaatttcagcttgttcgtttttggtcaggcatttaatattgtacataattttcctta

SEQ ID NO: 5 - DNA, 166405 bp, Artificial sequence
  Synthetic polynucleotide
  misc_feature: Ec56, E. coli bacteriophage
ttaggccgcaagggccttcatagttttagcgatttgggaaacttcatcatcacttaaagagttgcgataaccgatgaagtcggaaacaatacggaatttcttggtaaactcagcaaccattttatcactattttttgaagcattacgtgataattcatcaaagagattagttactgtccagatatcatgaccgatggtatcttttccaccattgaaatacacaccgcgtaatgaactaaccatattaccaagtcgtgtatattcttcagaaacttcatctgtactgaagtacttcatcataaaatctagttcaggatacttgataattttatcaatatatcgttgagctgaacttgaataacctacatacttatcataatctacatcatcaaaagcatctacatataaatcacgcaaagcttcaaaaatacattggcactgaccgagttcttttacctttttctgtaaaagcggacgaataacataaaattcattaatgccaataagattagccatacgaatcaaaatattcatagatggatgacaaagtgatgtagtaccatccatagagaaaatatcagaacgatgcatatacgctacataaccagtaatttcatctgcttctgacgtaagtgtaaataattcctctttttcccaacgcccatctttaatttcaaacttaaatgctgtagcagctttaggacgaggagctttacttttaactacctttggaatatagcttttaactaaagcttcaatttctgacaaataatgaatgttaacttcatcactttcaaacattgccataatatcaggtagtaaatcaatctgcgattctacttccggattaataaacagaagacgctcattgtgatgaatatttaaagtgttattaaattcactatcatctagcgcatgtgctaatccacggacaatattaacacgatttttaatattatcaataacgatattaatttttgttgtattaataccaaacagacgataacttgacgcaacggctgatgtttcatgactttgcttaatgcgtttcagtcgagggtcaagatttacttcatacacaactcctgcattgcataacttactgtcaggttcaaacatgctctgcatctttttatatgacagatttttagtcgtgaatttgactgaattactaatcatataatctcgagcagaataccccatcttcatcaattcacgatatgtgtgacgaggagatgtagattctttaaatcgttttacatcttcattaaatgctttctcactgagttctttaactcgttcaataatatttttacgagtacgatcatccagtgaaagagcctcgcgagatggagcaatatcaagtgaacccattggaaacttaatgtaattcacttcattgcgaatgcttagccagttacggtctctaataacaccatcgataggataaacaataccgccatagatagcatataatccaccacgatcaggccagtatctttctggatttacaccataataatcatcaaaatcaggaaaataatcaatttcgcggtcaagaccattaatgatagccaaatctttgaacggtcgcatgatataagaaacttcataagcaaagtttctaaagtctttttcttcaactggaactacgatttcaataccagttttatcatctggacccatttcttttacgaatgtaggtttaatctgtgggccatcaccatccatgtaagctacataaccacgaatttcacctttatgatacgaagtaatactaaacgtatcagtataactaaacggagatttagaacctaaaccaaatccgccaataaagtcattagattcagccttagatgaactgaagtatgaattatacagcccaggagaattatcatcaccctgaatatcaaaatcactcatacccggaccaaaatctcgacaaacaaatcgtggatctaatcgtcctggaacttgaatgataaatttttcaggatttccattaagtgcatgagcatcaatcatgttagtaatcaattcacggactactgcgcgaatcttgtttgtatacaaatcagatgacagaattttaaatactttaggatttgctgcgatgctaaatgcttttgatttagaaccattgccaagaattgtttctttttcagtggtgataatcataatttcctcattaattcatattacgtttaataacttcagcaacttctagtagttcatctttagttgcggtgtcggattgaattttatctctaatatctttaaagcggtttttaaattcttcggcttctcccatatcgaaaaagcgttgaatgattctatattctcgatgaactgctttatcaaaaagttctaaatttactctatatgatttcatttcaatatcctcatttgcccaattaattataccacatccttgtgtaaagtaaactactggctcatccattctttacgaaggtcagcattatctcccatgagcatttcaaaaagctctttccaattctcaggaagtttaacaacatcatatactggattttgaatcatctcacgatattcagatttttccaaagagccaagtcccttaatataacggatgctatgtttaggtagagcatctttggcactctcatattcagcgactgtataaaaccattcttgttttttaccgacctgagcgatgattacaggagttttgacaaagcgaattcgtccttgctcaaacaattctggccaattactaaaaaatccgagcagagaaggataaatgcttcctagaccatcatggtcagcatcagtcataatagcaatattgcgataattcaagttttcagctttttcaccaagaactagaccagtgattgcgcaaatatcaaatagttctttgtttttaagcatatcggcatatgacataccccagctattaagaactttaccgcgcaatggataaccaccatgaagttctttatcgcgaacatcaataagatatccgatagctgaatcaccctcagtcaagaacaatgtagtgtcagcatctttaccgcaaagattcgctttaatatgtttatgaaccttagctttagaagcctttttagctgctttagtttctgctgctttttctgccgccaatttacgagccaaagcagcttcaataatcggcatcagaattgcttcattatttagaatagcgcgtgaaatctttttagcgtcaagttgaatatgactacgaatttcgccaaatggagaagtcaaacgctctttagtttgagaatcaaatcgcatgtttttcatatcacgaacaaacataacgatagtcaaacattctttaacgcgtgctttagttacatcgattttgaacttacgtttgatttgtggaataaggtcttcacaaatatcatccataacacagtcaatgtgatggccaccattcttagtatgaatgttattgacgtatgttaattgacgaaaaccatccggtgaacgaccaaccgcaatagaacaattttcttgttcttgaacgatagcatgttcatcatattggcgtgcgtatttcttaaaattaccctgaacctttttaccattaaaggtaaattgaatatcaggataaacaacagcaagtgtttggagacgatctagtgtaatgtcaagataaacttgggacagctcattagtttcaaatgacataaaatcaggaatgaaagtaacacgggttcctttccattttccaggaatatcttcccatgatttattttccatgccgtttgaacaacgaactacaatattattttgaccatcaccagtttcaccgacaaacatcacagaaaaaatgtttgtcaaactagaaccaacaccattcataccaccggtgacgcgttctttatcatcaccgaagttaccacctgcttttggaatagtccacgcagcaacaggaccaggaatttcttcaccggtaggtgttttaaccatcgcctgtggaataccacgaccgttatcttcaactgttacttgattatttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagctgaagagccaatgtacatgccgctacgctttttgatatgttcaatatcgctcagaattttaatttcattcttaatcatcacttatcctcgtttggtttcgggaatattatactccggtaatcataaagctaaaggcccgaaggccttttatttaaaacgaatagttgaatccttaaagaacagcccagaacatactgttccttctactttctgcccggtaggtccaatagcacgaaatccagtatgttggaaatcattttcagaacaaccgaaccagttatatccagtgatttcaatattagtaaaaccgcttgaagataaaactttggttgcattatcagcatcagtacatcctactaaagacactgttaatactaatgctgcaatagaacgattaatatatttcataattttcacttaaatttaatggcttgaagaagactaataattctcaagcgacttctttcatctttaactgtaaaagaaagagggtcaccagatttcatagtaatagtacattcaaaatcaaaatcttcggaaacttctttgaagaagtcaaattcttcatcataaattagaacattactctgacaactatgaagaatttttccatcatttccagatgctgtactaatcattgtaacattatgacctttcatatcttcaatgataaattcactagtcaatattacagcattaatagaactattcctattactagcagaaagtagatatttctgttcttcaccttcacgaatgcaatatttcttaccgattttaaacataattatcctttaagtaagtcgtaaaatccgccattcacatgcttaggagcagaaggccgacgagtagacaaacgatgacatttagggcaaacatcattttctcgttcagaaatctttttaattttttcatattcatgcccgcaatcttcggattggcatttataatcatacattggcataattattccttaaagtgtgctttcagcatttgatacaaggaccatgcctgttcattattttcaatagtaactttcatgacaggaaattctgtgaaatcttctatttgttcttgctctttctcttcctgctcttgctcttcagctgcctgatatggattttccacttcatcaaagaactcggcttcgttagtagagagccagataaagttttcgtcaaggatatcaccatgtgttgcatatccaattgtgccagtaaatgacataattttagtaggacgaccaagatggtcaacatctaaaattttaaaaggatgcatacctaaacggcgtgcatagattccgttatcagtatgatctttaataaaattttcttgagcttgtttatttttaaattgataccatttattaacttcaaatctaatagccattaataaatttccttccagtaagttgtgccatcttcagtaatttcacgaaatacaccgtaaattggttgtttatcaccaaccttttcatacacataaaccgaagtcaagtgagtaaacttaacggtatgttccttttgaaccactaccaaatctggatcaaataatacatcttcaaattcgtcattagtgcaattctgaacaattttacgtttcattacaatttcctcattaattaaacattggagcgatacgtttcagaagagtagcagcacctttagcgaattttacatcatgaaaaacagtttcttcttctgtaacaactcgaactttaatattttcacaatcccaatttttacgaacaatcttcaaaagctgcagtaaatctttacattcagcaatatcgataacacatccacgagaatcttccattatcgcacgataaccgtaagccataccataatcattaaaagattgctcgatgataattaagttttccattttattctccaagtttttctgtatcagtagttgatattgatatagtaccataatcaactactgatgtatatagttttatgaaaaaaaaaaatttaaactttatgcaaatttatgctaaagctgcttcgcaccattttttaatttggaattcaggaactaccatgaactggcctgcaaaaacaatattgtagagcttgacaccatcttctacccaacggtccgaaataaaaccagcgacttgattcgttgtccatggagttccatctgttgccgccgcaattgtgaatttatggtcttttacaactaaaactgaagaacaaagtttccatttaaatgcgcgttcttctggctcaatgaactgacttgagacataaccaatgttaccatcagcgtcacgaactttaacctcgttacgaccaaaaactggatcacttacagaaagaacttcaaccagctttcctgcaactttagaacgagaagcaacggatacatatacgtaatcaccagtagagagatttacaatattcataataattccttaagctttacgaggagaagcataacgagtgatttcagattcttcaacaacccggaagtcacctaagaatacgatattgtagagcttttcaccatcttcaacccattggtctgtgatgaagccacacatcctatcagttttacttggaccagcgaaatcatcaatataatcgaattcttcatcagttacaaattcaacgcctttacacaacgcccatttaaattgtgtattagactcagtggattcaacttcttcaacagaagcaaaatgagagctaacacgagtttccagaaatttaggacttacgtaagcgtactgagtttcagtttttccagaactaggaatgattcgaactttaacttctttaacacgaccagtaccattagtacgaagtcctaccacttcaactagacgacctgcagctttagaacgagatgcagacgatacacgcttaatttcaccgatagtaatcataatttttctctctttgttgttaagatttatactccgcaggaccattatactctggtcccaagagtttgtaaactagcttacacgaacattaatcactgcgctgcgaggaactacagagtactctccagcatgaactacgttcagaagttcaacaccatcttcaatccactgatcagtcacccatccacccacaggattcgcgaatggacgacgaatataaactgccttacacagcagatcagttggatcttcaggtttttcaatttctgtcaatagactaaaatctttttcataaataataagcgatgataccattccataatagtttctaatttcaatatacatcataccgataagaattccgctattaacactaataacagtaaaaggatatccgccagttaaaccaagaagttcacaaaacttattatgagctgtattagacagtaccgaaaaattcttaatttcatcaaattttttcaattgataaacagcattatttttaatcatgattttctctttaatctaaagtaataaagccttttaattcggcatgtgatttgcggaacattacttggtgcccgccaatgataacttgatcatctggcacttcataaatcgcaatgtacattccacgatcttttaagtcttcacgctcttctcgagtaaaccatctcattatatcatattcactggcgaaagcaaaatgatataatgcaataaaccacaatggaatataattttcaattcgtgaataatctttattccatttagttttaatagcatcattagcattttcaactaataacttatcatcgtgtggaataggaatactttcatgactttcataatcattgctatgatgatgaaatgatgatgaattaataccgcaaaattttagccaagttcgagttttcatagaatcaaatccacgataaggagttgattgaacgcataactcttgcctaattttgactataccactatcatcatttaatgcgctaaacgatgattcaacacgataaattttcattttattatcctcagtagctatggtgttatagtaccacaactaaccgaggaagtaaacaactttttatcgttttgttggaagagatagaggatcgcattcttcctctgatggagcatcttcaagacccatagcgtatcgcaaagcatacttcatcatcaggatgtctttcgcacagtcatgaatagaatcatgtgcaacgaatccatctaaagttccttttggaagaggacacgtggtcatatcacgaacaagcagaagtgcttcaattctggtacgaatatcacgctgattccagaatttacatggttctaacttaaatgtatcaagctcattctcggaaacgccattaagacgttgaatatcgcgaatgagatcgactaaaattggaaaatcaaacgacattccacggcaccagccttgagatttccaaggatcgatattatgtgcattgatgtaatcgttgaattttgcaataccatcaatggtgcttacatcttcatcggatggtgcaatattttttcgagcttcaggagactgatttttccaccattcgatagtgcttttagtaaaaagacgatgtcctttttggctttttaaatcaaatttgattttaatgccacgtgaaactagttcatcgaatgtttcaacaacttctgggttagagtcaaaagcaattacagccaaatcaataacagctgctttttcaccgcttcccattgtttcaaaatctataataaaatcaaacattaaattttccttgctaaatcgcgaatttgacctacagtataatcttggatataaactttattaataggctcatcaataaattttgccatagattcaatatctttttgtatctcttcaagactgtatactatctttaaagctttttcgcgaatagtaatattttcaggactagaattttcctcaatgacagctttaacatttgtcataagagatttaaactgatgcaaacttaattcaatcattaataaccgccttataaagatggctaatttcacctaaaacataatcactgattgtaacagttttcacttcaccacaaaagaattctaacgcaattaaatctcgttcaatttcttctaattgaagcatcaacttactagattcaatttttacagtttcacgatttttaccatgagcaatttcataaatttcgctaactttatcctgaagaagataaaactgatctttagttatttccacgaatagcttcctcaaatttaattagtaatttacagacactttcatctagtgtaattaccgtatctgtattactgtgatatgattgtttttcaattcgtttaattgctaatatagtatcacttataagataaagcttatgaaggagctcagctcctgttatcataacattaagattatcttgcttattagtatgcttccttataccatctattagacgatttaaatattttgaattgatgttaatcatatatcctcacacataaaatacgtcataacgaccacgggtaacaccaacataaagaagttgttgagccaattcagcatctgcataatgaatacaaggcgtataaatgaaagcacggtctacagacataccctgagctttatggaatgttgatgcaggaagtgctttcactttactaaactgtgatttagcatcccaaaaatcactccacggagcttttccgcctttgttccaatttttataagtttctgccgttttacctaaaaataggttaaacttatatagctcttcatcagatgaaattattttaatcttttcacgataatattcatcatcgccgtaagtttctactgttaaatcccaatgacgaattaagtattctcctggaacaccacgagctttaacaaacgttgatgtatactctgcttctataatacgaactaattgtccattattaaaaataatttctgatacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagagatttgacgattgaaaaataatttaccataaaatcgcgtaaagcggtatcaccagtaaatccacgtactccatgcccgtcaacaactttatcataaatccacttaccgttgcgaacatcagtagctacatcaataataggagcattactgcgtttaacttcagtgagttcacactgataaaaatctttatgtgtaaagaatggactgatataagcagtgttttctcctgggtcaacaggtctaatttgcttattatcgcctattccaattatagtacaccacggtgggatagttgaaagcaaaattttgaagagctttctatcatacattgacacttcgtcgcagattaataccctgcatttagctaaatctggtacttctttttgttcaaaaagaacgttttcttcatacgtaactgggttaattttaagaatactgtgaatagtactcgcttctttccccgacagttttgaaagaatctttttagctgcatgtgtaggagctgccaaaatgataccagtttcgcctgttgatattaaagcttcaatgatgaacttagtaagagtagtcttaccagtaccagcaggtccattaatagttacatgatgtttcttttctttaatagccctcataacgatgttaaaggcatttttctggccttcagtcaaatcatcaaatgtcatcgtaaattccctgcaattggtatactaacaatacgcccagtatctaaaattcgccgatataatctttgtgtgtctacatcaggcttaacatgtttaacttctattttattaaaccaaaacttgcgtggagtctcaactaatcttggaattcccttacctaaagctagtttatattggtctttgagagtagtaaaaactctatcagcaatctctctttcaaaaaatacagcaggacgatgttcatcaagtggaactggcgccgtaaatccgtctttgtctcggtaaactatcgcatatacataaaccatattatcctcggataagtttaaaaattgaacaatttagcgggtatcctcttttcagtttaagtttatcaataaaagacaagttttgataccgctctacaccttgaataattttatcacacatatcatattgcatttctgcttctgacaactttttcacaattttccaatccgagcctttaagaagaacgttcagtttaacaacttcagcgccttctgctatgcgagaaccatcaatacgagctttaagtgctataatccttagcttaatgtcagaggtctgttttgatttagaaagctgagaaatgtgttcaattcgattttcacgctttttctgtatagctttaatttgattataagtctttttgattttagcccatttcttttcatctaaatttagtttatgaacttttttcgcagatgaacgaccaattcgcaaagcaaataaatcccgtttttcaatcaactcttctaaagtataatcagaacgaaatgtattatactttttctttactgcaataacattccctttaatgtatccaatgttattatcaaaacgttctaatgataatttctctccttcaatacgattatcaaaaggttctcccgagtaagcacaaactttctgatctaaaatgttcttaatgtaattgaagtctaagttaaaatctttagaacgtctttttgcagatgcctgagtatgctctaaacgacgtttaattttacgaatttggttattagacagcttcatatttttctcacatcttacggacggttaactacttatactataacatttttactttaacttgtaaataactttatgtaaaaatgctttaaaaatttcatggtataatgaatctaagtccttccattatagattaaatccttcaaaatcaagagtatagatagtgtatgttgaatactttttatactcatatctatctgcaattctaaatacacttccagctggtatcattacttcttgttcatctgaaactaattccatattacgataacgatggctatccggaaacttaaagtttggattgtattctttacagcgtagagcttttatagcatactcctggaaattgaataccataggagctttgaattcaaaaataacttgtgtgttatactctaaaccggaagcaaaatgtagagctatatttttatcatatgaagctgatacgactttatcaaatgtaataatatcaattccttgatttaatacttgcttagtctcagctggaacacctctccaaagaggtttatcgtttggaaccaaacgagatttgattatttcatttaaccaagtatggtcatctggtttattagtaatacaatgaattaaaagttcaatttcagataaattaaacccttcagaaagtaattcttcacgaatagaagcacgcaccgatgcatccattgattttattttaaaatcttttagttgcattactgagtatttcattcaactacctcaatatcataaactttaaatgttccaaatgaatcgtgtaatttttcttttgaaatagaagttattctatactttccaattggaatcatccattcttgttcatgtacaatcatcattaagttatcagttctttctgaatctaacccatcagtatcttcatacgtgtacttaaactcagtattaggagaagaaagtataatatcgctgatatggtcagaataattaaaagctttatcagtttttaagcgaagtactatttcagtgaaatattcagcataagaaaaagaacacgctgtatgcaaactagtagtaaatgaatctaccctgttcgttgaaaacacttctccaacttgcaaatctttaataagttcttttgtcgattttgatataccacgatataattgataaggcgatttagttaaatgctttttaatgattttattcaactgtctgtgaagagcttcattctttttggcttccatacattgccaaagaacagactgctcaaagtcagtaaatttttcacagacttttttatacatatcatattgaaaatcaacgctttcagcttttatagataactgttcaacatctacaggattaataatcatgatagcctccgtatacttcagaagctatcatatcatcgttagaaaggaaagtaaacaactttttgaattattttgcccagggagcccaaggcggagggtcaagatggtatgaagctagttcttctagaagagcatctggggcttcaattccataattctgtaatactatacggtactctttcttataatcactagaatcattctggttattcgtagaatgattatcttctaacatctcaaataaatccatattaattcctagcgataaaaaccaaagtgacgattagcttcaatgatctttctttcttcttcggacattctccagcgtagtccaacatcaaaatgagcccagaccatcctaacaaatgcatttatatctttaatatcttcaataatgaatgttttacttttagaaggttgactcgctaatttaactttatcgtcttcaaacatgtcaaaaagaccatattcatgagctcttttatagcctttaatagttaaagcttcagaagaagaaaatggtgaatctgtattctgcaaaatatcttcagtatgctttataattagaataacattttctggatattttctttcttttatatctttaattaaaatatccggattttctgctaaaggaataattaacgagcattttttatcaagtgtatttactgatttaccttctttagacataaattctattgaatataattttgctacttcaatcatgtgatttccttttgcctactaatggaccgtcaggaattttgttttcctgaatgtatttctcattttcttccatcattttactaccgattttaagaagcaaatccattgcttcatttgctttagcctttgcctcttctaacgtcatatctttggtcatgatttatcaccatagatgtctctcatcaatttaagcgctgagcgttctaatttcttttctttctcagcactaatcattgatttcatccattcttctgactcgttctgcatttctttatttgcttgttcaacccaaccatcatcaatatacattgagtttggtctattgaaccattcaagcattttcttcagaactttcatttgttttacctaaaacaatagtaggagcatcgtcaaattcatgaatttttagcaattttggatttaaattattccatacataataaataaagtatgataaagcatcttcactcgcaattataaatttatttccttcatttattttccagtcatatactgaatcgtacgaataaaaagataaaggattaccattatattgttctgcgctaacattaatgtattcggatttagtaaatgcttcaattgctctaaacggactatttggcacagtttcaataattccgatctttttaagttttatttcaacatcttctggaactggcattgaaacgaaattttctacgagatacatagggttacaataacccttatcaatcactacggctacagtaattggaacatctttagcaaacgacatgctattactgctaatatacatttcaaacaaaatcgcttccataattttcctcaatcacaagatgtagatgaacaactagaatcacaagaacttccacatgaatcacctgcccatacatgaacaggaacattggtgtcatatgaatcagaactagactgtgtattctgtgcattagatgatgtagtaggtactgaccagcgccaaggatttttataatattcttgggcttcttcataagtcatagtaactgcttctactgttccatctcccatataaacatattcaactacagttaaaggaagatagtcatttgaaataggaactacaccttctcccggagttgtagagaaaaaatctgtaaagaaatttttaaaccaattaaagataaacattacaaaaagcctctttgaaattcgactctttgaaatccaccccagtcagtatatcgcatttcagcattgaactcgactgaaccatctgcatgcatcatgaatgaatgcgtgacgacatcacaatcccagcttttcataccccatttatcagagatagctttatcaagaaccttctgaaggtcttcatttggtttaatccaacgatttaacatagtgttctcctctataagatatttttattataccacactcattttgacatgtaaaccataaaatgaaaaaaggaatcccgaaggattccttaaattatttaaccacctacaccaggtgtaggtgtaacagtccaaagaccttcattagcagtgatccattcagtacgctgattttcttcatatactgtagaatatgctgctttttcagaagggaatgtctgataatgagcaccagaaattttgtgaacatcagaataaagagggaaagctacagaaatttctttaccctgaattgtaccaccatcaactgcttggtcaaatgttttgatattaacataaccgcgagtactagccatgtaattctccttttatttaaattacatgattatttataataaattctcgcggaacgttaaaatacccgattttagttaatataacaacatcgccgttaataattaccggagaataatcttctggagcattaaatttccaatgggctctaatattatatccatcagaaccaaatgctcgcgtagctggtctcccagctttttgccatgcgtagaaatcaaatttcattttgaatgctctataattaattttaaagcttattcactgacaaaaatttcgtcaggaccttctataacttcaaccatacgaagttgattagttaagagctcacatacgagctccttgttataatctttaaatagctggtcaatacgtttcttatgggctttcttgagctgacgcttatttaaacgagccattaataacctcggtcttgacgagcgaagttttcagcatttttcagataataaagtttaaatatttcttcagctgacattccaagagcaatgaatttattcatgaaaaagtgaaattgatcaatcagttcaaatttaatttcaagctgatcttcaggagataaatcttgaattttcttggattgcatttcagaataacgtttcttccaaggtttccatacagcagaagcttctttttcgccattactcataccaccgagagaagtatatagctcgcgagtttcgtctgcgatataatcgtcttggtttcgcaaccaagcaagaacttctcccgcagtttcaagtgaatcaggatgacgatttgtttctggtttatcattagccaaacgaatctgtaaatgccgctgcatgtcaagcataacctgcagtgggtcaatattgtgcataatattctcagcatatgcacgatttgctttatcaacaccttcgatcaaatgagcacattcattaaagtaagccattatttttcctttcaattcatgggttagtagattaattatacaataaatatataaagcaataaggaggacatatggtacaaaaattaatggcacttgttaatgccataaaaggtaataaaaaacgtatagcttttactatttctgctatggtaggaattttactctggaactttattctatcacctgttgcaattgcacatggtattaatattccagtagttactcttgatacatttgtagatttagcatttgctttagttgggttaatttaaatcttagcatatttagataaccgcattttagccatcaacccctgggcaatattatttttcatatattccataatttgttcaggggttgcaccttcctttctaatcatatcattaacatcttttgatttccagggagatttatcccaaaacataaccctttctcctgcatcaactaatttagtcattcgcttaatagtgtcaggatgacgaggttcattatctaaaacccacacacgtctatctttaaatggaacaacttctaggtctaattgaccacccgtaatagctataccattttcaataaaaagtgaatctataggtccttctagaacatatacatcaccatctttaactcgttcaacaccgtaaatttttgttgcctcaggataagctttaatggtgatatatttttgaggagcatctttctttaatgcacgtccttgaaaagactcagcttttccattagcattataaattggaataacaagacgaggctcagaaatttcctttttgtatgttcccggtgctatgctattaactaatttaggccattcagttgtaaaccaaagatatttccatttatcctttggaatacaacgagcttttacatattttataattgcatggtcttccgccagtttatctaatcgaacacatgacggaagagatttaattattttcttctcaggttgtttaggaagttctttaggtttttctactggacgacttttacctttttcttttcttatttcaaagatatactcacgatataaatcaggttcaaactcctttaaatatattccgattggtgcatgatagttacagttataacaatgaatatttccttcattattatcaccataataccatccacgagctttattctggtcggtttttgaatctccacaaacaggacatctaaaccgcaatttaaaagttgaactattatttacttgtgtgaatttaggtaaatgagctaatgcacggtatgcaaactcattatcaatccaaggtattgatgacatttttactcttctttttctttagattcctcttttttctttttaggaatctgctcagggcctttatttactacagcgcctgacgttgttccagtagagatattttcaggattaccacctgaatctccagcgaccatatcttctttaataaattctttatatgttttcatattaacctctattcataaaagcattaaaaatttggtcatcaatagatggaatagcaaccttttcggcatcatttagcaaatcattaatttcatcagatagcataacacatgtgcctttatttcctgtaattgttactgcacaattacgaacgttttctttatcaaattttaggttaatattttcgtagtgaaaatcctttaatgccgaatatatctttaaaatgaaattgtcttttactacaataaacccaacttcactattaaaacgtggttcatggaaactgtaataaaccttttcatctataaaatcgtatgaaattttttccatttttaaatatgaaaattcagaactatacatattaacctttattcataaaagcattaaaaatttggtcatcaatagaaacatttactttagactgtttttcagatggcaattcatatccacatattacaattttgtgatcaatatcaaaatatacagaagcaatatgattaatgatgttttcagtaaagtctaaatcaacatcaatatctttttgaccacagcccaaaggataaataatgcgagtaattcgattatctttaacaaatattccaccgacatactctgtgctgcgtttaaagtctacacgccgacgaaatgaaaaatattcaggctctttatgagctcggctcataggacacaacgagtaactagaataagagatgtcaaatcctacgccttcgatatgagccaaagtgtcatgattaaaccaattataatcgtacgccaaatccattagattataatatgtaaaaggcaccggattaacatcattagtcacaagcatgtaattagcaactgctataatttcattgtttttaacgaatacaaaccgtgattgatgcgaatgacctggacccgcgttttcacgattaatgatataacactgggcacctttatatttgtatgtatctttgcacttgtgcatttgatagagcattattcacctaccacttcagcgatgatatttttgttattaaagtttttatcgcaatacagaacataattatactgcattacaccaccagacttaagttgtttttgcacttcagctttcatttcaggacgatcgcgctcaacgatattcataatatctgcttcaatttgagtttcaacctcagtctgatcagcagtcatagaccattcgcacaaatctttatcataacctgccatagcaggctgagcagcacaagaagctaaagcaaaaattgtggcaaagataaattttttcatgataatctcctcagtagtttatgtttatatagtatctcaatttccaacaaaaataaacagttattttaaaacttctgcgtaatcacatgttacaaactgtttctctagcttaacgatcttacgaaaataccttttacactgacgaatctgtcgcttcgtaggacgtacagcaaacttaataaattccactcgaccaaatggaggactttcttctgctggaatatctaacaccaattcccacgtatctgcaataagtgctttgaattgcgtatttttcctgacgttatacggagtaggtttaaataaaacaatatgcatattatcctcggcaatccacttcacatactttcttgtcatcaatgaaagctttaactaatgctttattaacttcagcatactgagtagtagcccattgaacgtcatctttcatcattgtggtttctttaataaacatgctttcattcttaaaccaccccataaaaactacctttaccaattccataacaatctcctcatttaaccaacaagactactataccatagtcttgtcagcttgtaaactaaaattttaattcatttgccaaagcatctaactgagctcgagtggattcatttctttgatagcgattctgttcagcctgaatctgttgtgaacctgctacttcactcacttcagttggagtagaatcttgttcaatttctacccatttctgatttcccttttgaacacccatcaaaaacttattccacttattcttatcgccatatcgtgatttgatttgcttaatgagttgttgttcagcagctgctagctcctcggtttcaatgaccgcaagcataaaatcagctgttgctggaagaccagcagattctgcgatatcactcatgttaacatcggaagagtcccaagcttgtttaccaacctgtgctgcagtccaaagaacagtttcggtttcaacagcaagagcacgcaattcctctgcaatagctttaacagttgtgtaactattttctgaataaactctaatgcggcaagatttacaaatacctagatagtcgacaataatgattgttggaacaaaattctttttgagcttcaattcattcaagagagacctgaatgtgttagcatctgctccaccagtagggtactgtttaacgattaaacgaccaagagtagatttctcacgccatttttccatttttcctttatactcagcgtaagaaatatgcccatcatcaatgtcatcaagagaaacatcgagcatattagcgtcaatacgtttagcacagacttcttctgccatttccatggagatataaagaacgttatgtccaagctgtaaataatctgctgctaatgaacacaatcctaatgatttaccaacgttaacgccagccattaaaacgttcagtgttccagtttcagctccgcctttagtaattttgtttagaattctgagtttaaatggaaccttacgagctttattcatataagatagccaacgtgcttcatagtcatccatccaatcatggccaacgtagctatcaaatgaaattgataatgcttgtcgcatgatgtcaggaatagcaccaacatccggcattttcttatttcgtttttccggaggaagctcagcattagtttgaatttcgattattttagacgtagcattaaacatcgccctttgctgaacatatttttctgtttcttttactaaccagctgtggtcttctggagaatcggctagttttgaaataagtgtttttacaccagaatattccgtttcagtaaatgaactattttctaatgcaacatttaacgcattaatagatggaacgctatgatactcattaacatgagatttaattaatttgaatgtatttttagctggaccactttcaaaatattctgaatccatatatggccaaacttttgaaaaataagcttgatcaaatataagatgagaaagaataatttctaccacacttactccttaaaagaatttaaactttttctttgaccttttattaaatgcatcttgtagttgcattgtaatacatttttctacatgaggagctaactcagcttttctttcttggtcaagaacagcaaagtccattacaacctttccatcaacccaatttaattttgtcacatacacaatgtgtgtagaaccatcttctagtttaatgacaatctcctggataacattttccatggcagatttaattatcttaagagactcattaaaaagacgttcttttctttcttcttccccctccgaagagggggattcatcgataatttctagatctaagtctaaatcatctttattcattaaattcttccatatcacttaactgctcgaggtcagtttctaaatcagcagctgatttacttttactttctggagatttaaatttttcaacctttgagttaattaattcatcaacttcagcttcaacaatttcattactatcaatagcacctaactgataagcacgcttaatagcatcacggaatggttgatgcttaaataaaggaccccagaatgtagtgcagttggtatcttttgcacgccaagatttttcttcgcgaatcatctcgccggtttcttcatcaagaaattcacgagcataccaaccatttttaggttttaccacgaatcctaattctagagccatatctaacaatccagaataaggatcgataccgccgtcaaatttaacatcaataaagaatttacttttttctttaacggtacgagatttttctacatttagaacaaattgatacccttgaagatcagaaccatctttaatctgacgtttaccgataatgaatacggtatcagccgaatacattacgcctgtaccacctgtcatcacggttttactaaacatttcaattgtttcaattgtatggttaaccgcaacacatggaatatttttaatgctaaagtaaggagtaacaatacggaataatgacttcagtgatttagcacgagtcatatctgccacagatttttcattcaaggcatcttccgtttctttcttagaagccatattaccgattgagtcgatgaatacaataaccttttcaccacgctcaatagcttcaagctgattcaccatatcaattttcagctgttcaactgactggattggcgtatgaattactcgttccgggtcaactcccatggatcgcaaataagctggagtaataccaaattcgctatcatagaatagacaaaccgcgtcaggatatttgttcaaatacgccgcaaccatagtcaaagacatatttgatttaaagtgtttagaaggacctgcaaaaatagttaaaccagactgcatgccgccatcaatcgcaccagaaatagcaatattaagcattggaatttttgtacgaattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctattggatgaatagcattaaacttatgaaatgcttctgatttttctttacgcgaaacacacatgcgaagaacttttaatggctcgtcttcttcacccaacgattttcgtttttcaatattcgacgttttccaacgagcttgctctggaaactctctattgatttgctcaagcgctctattatgtttagaattactacgaattgaactacacccaccaggagcttgcgctttacctgatacaaccagatatttgaacaaggccaaatgcggataaccttgattaattaaattgagaaatgcatacatatcttcgcacaaatcaatttttccatacccaatttgttctgtcgtaagttttccaaggtcataccatgtattcgtgaatccatatgaattttcacgataattaccccaagatgaagtaattttaaaaattggtaggcgagcatgaccgtgataatacccgcaatccatggcatcttcgacgtattgaatcaattcatagaactgttcatgagtcaattgattgactttatctacacatcggcgatcatctctttttcgcattgaactcatacgaatagtagtatcatcgtcaatcatccatattcgttgacctgcatacatatcagtaattgctttacgagtaccggcaattccgtttacatcatcaggaatagttataattttagctctagacccataggcgtcatgataagctttttcttcatgttcacgcactacaatatggggttcataatcagtcggaaacatatcaagggcagaaactgccccgacacgctgataacttggaattacgaattgaatcaactacaatatggggttcataatcagtcggaaacatatcaagggcagaaactgccccgacacgctgataacttggaattacgaattgaatcatttccactcacctttatagtcttttttcacaatatgagtttcgccagtattccaccaatgatcaaccaagtaaaaatgacgagaatatacatgaagacttccgacattccatataatagaacctgctttatactgacgagttgaatcgcctgcattcaaatcagatactaatttatctaatacgtatttttgccatgcataatcattacggaatccgaagaccacgtcatttgagcgcatgcttactactgcattgactttcttatcacgaatcaggtactgtactgtattagtacacatgaaatctgacataccatctttattgtaatcaaattgcatggatggacgagtataaatcatgataccacgtcgagaatcaggattttgaccaagttcagctaagcacatgtcatattgagcatagttatcttctgaccagatagcccaaccataattcgagttaatttcgcctttagaagatgctacctgctgccaaatctttggtgtttcacctggaatatctttaacaaacaagctcttagatttataccattcaagttcacgctgaatgtattcatcattaagagcgccaaaaataaacggttcatctgctacaaatgatgcgccaataatttcaatagttttaacaccagttttatcaactacgaaatctttttcctttaatgcaagccccaaatgaagacggatttcttcaactgtcatagagtcactaatcatttaaacctcaattgatgcattcatatttaaattgtaacagtaataaaccccaccctatgataagagttggaatcatagcaggaactgttacgctatagtatatacttattataaccatcaagattaaaagcaacactgttataattttgcttttcattttttctctctgatgataattacctgatttggctgtgcagactttttagtttcaccagcaattgaccaaataaatgtaataaaccaaccaataattgaccagttaaacagtaaagatgtgaaaaagattcctactgtcgattttgacccacgcatcaaggcgataaaccatggaagcatgtatataataatagccaacacacctgaaactaaaaccataaaaattgaacctgctactaaagtttccatgttttcctcacttagtcaatttttttacacatgaattataagaattcactacatactccatcggagcatttttaccagtacgccattggtaattattagcccaattagcccaaatttcggcgcagtagttttcaattttttcttcgcgtgtaattacatcagaattacgatatgcttgagcagattcatctggacgaatagcttcgtcaaaattcgcctgcatttgttctactgtttgctttggagcttctttataacacttgacattaggattataaaatttgcttgaacagtttacaatttttcctacaccagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacggtgctagattcaatcacaggttgagtatcattttcaacactaacaaatggaactgctgctaatgcaactaaacaaactgctaagcatcccataacaattttcattttattctccaaatctgtatcagtagttgatagttgtatagtaccatggaagaacagtcttgtaaacagttttgtgaaaaatttttagggaatccaaagggtccagaatcatctgtttttcataagtatagatttatattacttgtgtgaaaaagggacccggaggtccctagatttattctatcagccaaacaggaagtctaacgaagccttttcctcatagtccatacctgccgattcacacatacccgcaagcggtttaacaaacgatttttggaacaaagttgagtagtcaatccaagacagtacgtcagaacgaatttcttttggaagttctgtacccgacggccaagcaatgcacttgtcaccaaatggatttccttcacgcaatggaagaaccattactttatttccatccaaaattggagctacacccagaccactaacagctcgacgataagttagcacaccgcgaatatgaaacggacatttaaatcctggccaacctttatcatcatatttcgctatatcgttcgcagtttttacttcagcaataactttatagtcaagttgacgatattctttctcaaagttcttataatattcttgaacagactcttcgccttcttgaagaatacgacgaatactttcttcaagagcttcttgaactgctttaggcgttgaactttgctgagtttccatacccatgatttttagatgcggttcagcaaatcgcttatcttccatatcataaacgttcagagcataacgctttttcgctttccaaaatccgccaacaccctttgaaccaagcggagggcaagaaatagcttcacggtccatatgcatcagatgctcgcggttattcatataatcacataactcacgatatgcaacatcaatcataggttccatctttttcttaccgaactgattcatgaattcaactaaatcgttctgctctttgaatcggtcaagaccaactttttcaataactttatctacacaaacatataccgaatcagtatcacctgctgcgatgaaatcttcgccattagttccacatactttattcagatactcattaattttacgagcaatccactgaataccaacttgaccaaaaattgtgatagcagtagcatttcgcaaatcatagtaacggaaatgaatattaccaagagcaccataaaggctgttaataagaattttacggttcagctgatttgtgttagcaagtgtagctgctttttcacattcttcgatcagactattaagaacagattcagtataattcgatagttcatttaagaaatcatcattgaacttaacatatcgttcaacttctggtttagttgaacaagaccctgcgcctttcataataatctttttaatagcttcggcattcatttcttcagcgaacattttctttttccagtctttacgctggaaaaatactttagcgatttcctttggaatgataccttcttgatgcttatcatacatccatccattcggagaacaagaatattcatcactcggtttaggagctgttcctgcgatatattcatgaattggatgaactttaaactgaccacgaatagtctcaggactaatgttaacctgacgaataatgctaggatacagagacgtcaagtcaaaactcataatatatcgacgagcaattggtttaggttcaaatacaaatgcacccggaaaactttgtttaacgtgcgaaccttgttgaggaataaccttatgttcacctttcaatgagttaaaaataatagcatcccaagttttaataggactcattacaccggaaaaaggcattttagcgtaataagacatacttaaaactagatcgataaacccgcgaattttatcaattgcttgaactgattctacgtcaatgatgttataactaatgtatcgttgatgattagtctcacgaagtttattaataggaccgtcgtatggtaatttaccttttttggtttcatgctgagcaactgattccaaagagaatgacggcaaattagtaaaagcgaatttcttgtacaaatctaaataatcaagaatagatacgccatcaatagaataaatttctttgctaccgtacatattttggataagtttagattttactcgaccgattggagagaaacgtttcatactgcgttcaccgagaaccattttaacgcgattcatgatatacggaacgtcaaatccctcaatattccaaccagtaaaaatagcaggtcgtttctgttcccaaagattaatatattccatgagcatatcacgctcattatcgaatggcatataaattactcggtcaagaatttcttgaggaacttcatcaccaccttcacagtcaagcttagcagctaactttgcatcccattttgatactgaaccgtacattgaattcaaaaggtcgaaaacataaaaacgatcatcaattgaatcgtaatgagtgatagcatcaatttcatattcagctttcattgggtcaggaaatttatcaccagtaacctcaatgtcacagttagctacacgaacaaattttcggtcataaacaatttctgaaccgtatgtatcactgatataagagagtttaaaatcgttcataccgagagcttcgagaccgatgtcttccattcgtttcatccaatctcgagcatctttcattgatggaaatttttgaggagcgcagtttttaccatagatgtctttgtactttgactcttccttacaatgcctaaacatagttggaagatattctacttcacgagtacgttcatttccattttcatcaatataacgctcaacaatgttatttccgactgtttcaatagagatataaaattctttcatagatattccttagtttatagcccgagttattaggctcttgatatattatactccaaataaggggccgaagcccctttgctttaaatttctattgtacgacgcgatataacggacttgccatctgtatttgtggttttgataatcgcatgaaatgcgcgttggcgtgggtaaactaatcgttggaattctttttggaattctatttgtttatcttccgggaggtcaaaaaccagttgggtagaagacagaccatatgtttgttttagattttcgaatattagaaaagcttcggtaaactgaatctctgattgtgtcatataatttaccttaattaccaatcgtatatttaggaacgagtttccattcatgtttttgtttaaaagaaataactcggaagttattagttaaatctttcataaaagttctttgaccaggaacgatttcaatcaatccccaatcttctaacaaccatgcaatcgaatcacgacgaacttcatcttcttctgtcatttcaacttgacgaccatccatacgaagcatttctttaaaatgaacgatatagtatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaaaccttttagttcttttaatactaaaggaagttttccatttttagtaagaattgatttatagttaattgcatcatttgtattaacttgataccgcttagcaattaacttaataatcaatacttcggtggaatcttcaactagttttgcccatttaccatatcttttaccacgaggaactgcagccattagataattaaaatgagcttcatcacttaagcctgatccaattaaattcatagcatatacagctggcatgcactctggaaattgtgataatgcattttcaaccatgaattttgaataatctttttgagcaatagagcatttagttttattattaatagctccaattatttcaaaaaactcattttcagctttttctttaaaagaatcagcagcggattggacagctgtccaatcttttgaataccaagcaacttgatgctcgtttaattgaatatcatcttcaaataagctcatatcacttccactgcatttcacatgctaactgaatgaaaagataagctaaatgcaattcagtattagctgcaataccatgatactgattattttcgccgacaatttcgtacatacgaataatactctgtggagttacacgtgaatagatttcttcggcaagtttacccacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttgcagatttcagtcaatcgacgaatcatctgcttcatcatttcaattttatcttcatcagttggttgaccgaacgtaataactcgacagcgtgactgaagcggtttaataataccatcaatattgttagcagtaataataatactacagtttgagctgtaagcttccataaaggaacgaagatgtcgctgagactctgctaatcctgagcggtcaaattcatcaataacgattactttttgacgcccatcaaatgaagcggcgctagcaaaattagttaaaggaccacgaacgaaatcaattttacaatctgacccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacagtaatcataatttcctcattcaagttttagtgtaaatttaagggccgaagccctctattaaaaatcgtgggtagaatcagcttcaagagctactacataattcgcatgttcaccttcaaatttagcagcgccttgtttaccttttgcccagagaagaagtttataatttcctggttgcattttcatatttgccatattgataatgaaattaaatgtattttcaccatcataatcaccaagagtcaaagaatatttaacacgagtcaaagcagaatcttctactttattaaaaccgttaattacgattttaccttcttttaccgtgatagcaattgtatcaatctgcagaccacgagatacacgcaacagctgttgaaggtcttcagctttaatttcagtaacaacagatgctaccgggaatggaattggtttattaggagcaactactgtactcggatcggctgctggccaaaaaattgttgagcgggcatcagcaattttaatatttccatcttctgactgagaaatttctgcatcatcattaactaaagacagaataccgagaaaaccgttcaaatcgtaaattgctacatcaaaatcaataacgtcagaaatatttgcttccgcataagttgtaccattaactgcgcgagtcataataaattgacctgatttaagcataatgccagagttaatagtagcgaaatttttcaaaatattcagtgtgtctttagataatttcatttcaatttcctatttacataatagttagaccaggaccgtacagcaccctgataagattcgtcgttaaacccattagctactgcaattttacgaaatttattataacttggttttccgtaagcatgccataaagattttaattcatcttcatgttcaatccaagttcctctagctttagattttctaaattttgatttgaattccggtaaattatttctaacagttgcttgaattgaagctctctgtcttctttcagcattattccataattctttttgagatttagaaatttttgatcttacactttctgaattcattatatcactaaactttttagcataactacaatcaagatatttcaatttcatcttatttgagagtttaagctttttctcatcggtccagtgattcttcattgaattagatattttgtattttacttcagaactatgtttgtaacctttacgaataccgacatactcaggcgtaatttcagattgcgaaagctttacaatttttccagttaaaacatttttatatgttccatatcctttagcaccaattaaagtattttcatctgcgtatgctttattaaaatattttatattactctttgctttaacttttaattgaaaaaatctctccaattttcttggatctaatatagtttcagctaaaattttgacggtatatttagtggttttaataagttcaaaatattcatcgctataactcgatgacacgcttccagtataaatctttccagctgaatcaattatatttgttccatcgaaaattgcgttaatttttgaacctatataataacacggaaaaatatttttagcttcccgctctggaaagctaataagatatactaaattcatttattaaactcggccacaattgtttccgcaacaatttgtgcagcaacaatcagacgttcatctgcattaccgcaataatcatcttcaaggcgttcaccgcatgaagtcataataaatttagcaccagcgtttagggattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcatttctattggacattatttttgtatattctgctttaaatgcattcctaagcatagattcagtaactatatgctcttcattagaaaaattatttctcagaatatatcgttttatttcaggaaaagttaatagatgctgtccagttgaatattccatgtttttcctccatagagattatactctaataaattaaagcataatctcttataaattaaaccattacagtaaatcgaccaactttcttcatttgaagatgctgaccatattcttgcgggtcatggtctttatgcgaaattataaaaacattagtgtttttcattgaatttataatattagctacacctttaataccttcggcatcaaatgacccatcaaacacttcatcgagtattaacgtactaatactaacaccagatacaatagaagcaatatcacgccaagtaaataaaagagcaatatcaattcgtgctttttcaccttcactaaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagctgctttaacttttttagctttatctaccgtcgtgattagagattgctttttattgcgaatatcatttgccaacgactgctgagttttaatattatctcggtattcatcaacaagaacttttaaattatcacggtgtgttgaaagctgttcaaacgaatgcgtacattcagaaactttatctttaattttagaaacaactttatcaccggaacttaattgtgacaaacaggttggacataatccaccttcgtgatacatattaatgactttattatacgagtcaatttttgatttaattaaaactgcttcttgaccgattttattaaatgcatcagtcgggtcttcgtctaaaacaatattaactaatctttcattagcttcttctatttctgattttagcgttctagcttcttttgccaaatcatcatacatattttgaagacgagtaaggttgtcacccgttaattttttctgacgttcaacattatcattatatattttaatttgttggataatactatcttttttaacatcaagcacttggttttgtgaatttaattcacgtattagtgctttattaagcttatccatttcagctaatgttcctacctcaagcaggtcttccacaagctttcttcgtgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcgaaaacgtttggtttttgtcctcttttgatatagtactttttctcatcatattccatccacagttcaactaaaagttctttcttatttgtgctgtttattaattgacctttctttacatcacgaaatggcttgccaaaaagcccaaacgtgatggcttctaacatagtagacttaccaccgccatttcgtccagtaataagagttttttgaaccttatctaattgaatgtcaataggatttccacctactgacattatattttgatacctaactcggtttagtttaaaattcttcacaaaagattccttttaatgtatcttttagaccattctatcatatcatcataatctaaaaagtattcatcaaattcagccacgcaaacaacaccttgtgctgtttttgatgtaatataaattattccaacatatctagaatcttcttcggtataatcaatatttgctatgaattcatcattaatgtcaaatgtcgaaaacttcacagtatgcatccttaatacaagatacagccatatcttgtaatgatttaggtgtgtcattatctaaaatgttgaagttaaaagatacagcccagtcagtgcagaccgtaacctttttaatacaattatcttcaacctctagcggttcaaaccaatattcaataatttctttatgaccaatatcatcttttacttcgcattcaaaatgctgactcatcataacatttttaaattcatcaaaagtcattgtgttgcctctacatataactgatttgcatattgaataagtgcttcacgatcagaatcagtgatgtctggaattgcattaatgtattcttccatcaacgtctgaagagattgaacttcaacttcttcactgtcatctgactcgacagagttatcaatctttgacacaactcgtaatgaatgcacaactttttctagttcagattcgaacttcgtcagatttttgtctacttcagttactataacacgtactgatagatttgtaaaatctttatagtcaatttttcctttaaatggataatgaattctacggtgccagatagtattgtttggaataaattccattcgttctgtttctgtatcaaacatccagaacccacgagggtcattctcgtcacctgcagttagtgtccatggtgtcccaatatatctgacgttagcagcctcagagatagtatggaagtgaccagaccacacctctttataagtcttaaggaaatcaggttcaagaccgtgagatttcattcctttataaaaataaaatccattcagctcccagtgaccaacacaaaaagaagcagatgaagttttgatgtgttcaagaatttcaccagtattttcttcgcacatccaaggaatcaaatcaatcaaacacccgtcaaaatctactgtagtaggcttatcatatactttaacattaggatatttagccaaaagctcagtagaggcatttggagttaaagtatttttaaagtgcatatcatggtttcctacaacagtatgtagggtaataccagcatcatcaagcatttgaactatttcacgagcgaactccatagttttatgcgtgattgcttttcgcacatcaaaaatatcgccatattgaatccaggtagtaattccatttttcttagaatattctattgcttgtttaattccatccaactgaatggattgaacccactcatcatcggctttaacgcctaaatgccaatcacctaaatttaaaattttcatatatcaagaaccgtcattgaaatgcaaaataaaattattgaaataaacccatctggtgtgctaaagaacccaatccaacatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcacgttcgcggtcataaagagttcggtcagatgacagttctttaatacgttcaaatgttgattccatatcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaaaccggatttactcatacgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcgtgaaaatcaaacatctgataaaaacctttccatgtagtcgtacgaccaatccaacggttgatattcatgttaatttcagaaacatctttccagtaagttgaccgaaccttcgcaatatccataggaggctgaaagttatatacggtcggtgcttcttcaatatcatcaaacagagaaacagtttctggataccattctttcatcagaactttattaaaatcgccattatcagaatggctaaaaataacatcagctcgacgaacagtttcttctaatcccaaatttcgacgcaaagaaagagaagaatggtcatgctgataaactacaacacgaacagaaggtttaatgttatcaataatttttttatagttattaatagtgtcttcttcaaccgaagtagcaggaactgaattgataattagaatatcacaatcatttaccagcttaagtgttttatcatattcttttgccaataaaaccggaattgaaaatgatttataatcatgcgcgcaattacgagtaaatgatttatctttagcataaaccaaagttacttcatgaccatttttaataaaccaatcacgttgctcgagtgagaattttgttacaccacaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctggatgttcatctttcataactgccaccattttttgacttgataagaatcaacccacactttcatattagggtctgctcttacaataggaggattaacttctttaattgaactatcatggtattctttttcagaaattttcacacaaagatgaccattcaaagattcagtaaatcctgcattaattttaagacgcttgaattttacgtgtgtaagcatcaatcatatcctcaatttgcgatctagtagtcttccaaagaatactgatgagttcatcgttatatggctgttttagaatatcccgacttttcttgatagcatattcgtattgagcaaaattattgttttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgatacctgtaatttaattctacaccattagatttaaaagcggtatcatacggattttctggatcaatatcaatgtcaagagctaaaacttccctgagatacattttaagcaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgctggacgaatgcattaaaacaagcttgagttatatacgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaagcagtatgcttggaacactttttccatcatctttttaaattcatgaatatctatataatgactagttaaatcagcatgatataaaaagtctaaaaacttttcatgtgtgctagcatattcgctttcatttaattcagaaacatggctttcccaatatccaacaccagtcttatttgggaaaaatgaaattttcatgtattggtcaacatagaaaattccataattttcaatagtaatagaaatattaataaatttcatacattcatcaacttagccgcttcgagagctgcatctagtgaatcaaattggtcgacgtattcaatcaattcgccgtaattagcgtataaccaccattggctaaattcatactcaaggatgaatccatttccttcaatttgagttaaaccaatgccatttgtatttacttcatatccggcaagacgcaaatcgttaataagagcttcgttcataattataccttagtaattttcaggtcagcaaattttttcttgcgttgatttttcatacgacgaatagttttatcggaaatttcatgtttttgataagctttagattctacgccaaaagctttaacatcaaattctgacaagatatattgaaccaacaattcgcggatagtgttgcgtccaatcttctgatcattctgtttcatcgtctgatgaagctctttttcccatttatccaaactttgaggagttacaatatcgcctttttctagcaaagaaactactttatcatatgcataagaattgatggcgtttttaatttgaatagtcatacattatcctcaattgcgttaaaattttattatccaaaaagggccgaagcccttagctaaactgtttggcacccttccagccttcgtacatcattgcggctgatattaatattgctcctgagcattttgaatatttgtgattccaaaaccagtttagaaaaacttcgtcatcaataccttgggctatcatattttcaaagaactgacgacgagcttcagcaattcgttgcgataatttagattcaggattcatttaaattttccagttaccattttcatcaataaatttaatccagtcatttactgaccacttagttgtatcgccttttggagtaacatttaaagtgtataacccctgcttaaaaagcattcgtttgatattcatattttcctcagctgtaacgataacactcgtttgatttacgtttagcaactcgttgagaagtattataatcaaaatcatcgtcaatgtaaactgattttttcaactttcttacttcaccacgtaattgacgatttaactcatctttaacttctgaatcaatacctttcattctacgccatttatctgagcgaaaaatgttttcaaccatatctttatgacttaccccatcaggagctttacgctttccgaaatagtcataatcacgaactttcaagtctttacgacgatacgttttacccatggagtttaatttccttagcaactgaactaaatacagcacgatcacaaatcatctgtttatgtaacttgagtataagataataaacttcaaaaccgtttacataagtaacacgaacaacattaccattaataaaataatattgtccctttttaatttctttatcaaccacaaccatatcaattcctcaaaggtaattcatatgttaataataccacggtttgaacttgttgtaaacaactttgtgaaaattattttagggaatgataagaagggaacgatagcttagaatggtaatatacagaatgtgagaaagaaaggcccagagggcccgtcttagtcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagtggacgatcatactcaatcttaccattatttgtaagaactttatagaaagtaaaaggagcattgagctcctttagaagttttgtaactgattgacatccaggacaacgaccaacttcatctggaattccatagacttcaatcttattttgtttcacaactattccttactgagagcagcattcagcttattagtaattttatccagacgctcattgaactcactagaagataagcccttttctggagaaatcaaactaattacgaaaaatataacaataaaaggaataaggaaaatagctccaactgccatgaacaaaaagaatgttacagttgtaagaaaatcagctaaacctttacgaaatttatacatattttacccttaattgattaaccaagcattgataagcactaaactatactgtgaataaaattctggaccaaaatgaaaaatcatatcatttatagtatccataatataattcaatttaatcatgtttccacaccccatcggtatttgaccaaagtcgctgattatctgatcctcgccacagctttttggtcggaagatttttctcatacttcccatcaataataacatcaacatatttaagcatttctagttgtttaatatcttcaaacttatatcctgtccacaaccaaatgcttttattgggataaagattttttactgtttgaacaatgcaatgaataacatctcgattatcaggatagagagggtcacctccggttatagtcaatccttctatataatcattattcaaacattcaattaattgttctagtgtttcaccagtgaatggaataccatttctagcattccatgttgatttattataacacccttcacatttatgcaaacaacctgtaacgaaaagaacggccctgcaaccagggccattcacaaaatcgcaaggataaaatctatcataattcattggtgtttaaccctatgcatgatttctttatttttaccgagattaaatccgcgttcgttcggatttcccaaataaccacatgttcttcttatggtattcatctttttaggatcagtttctccacaaatagaacaaacaaatccgttttcagtaggagtcatttcatgggtacttccgcatgtaaaacacttatctactggcatgttaacaccaaaataatctaaatgttgtgcagcataatcccacacggcctcaagaccttttaagttatttttcatatcaggaagttcaacataagaaatgtgaccacctgtcgcaatgaaatgatatggcgcttcacgagaaatcttttcaaacggagtaacattttcttctactgaaacgtggaaactgttagtgtaccagcctttatcagtaacatcctttacacttccatatttttctgtatcaagtttacagaagcgataacaaaggttttcagcaggagtagaatacaagctaaaagcaaatccggttctttcagtccactgtttaagatgagcattcattttagttaaaatttcttgcccaatatcacgaccgacaagaatattcaattcgtgaataccaatgtatcctaaagacactgaacttctaccgtttttaaataactcaattatgtcgtcatcaggtttaagacgaaccccgaatgcaccttcttggtaaagaataggagcaacagttgctttaactccttttaaggaactaattctacacatcaaagcttcaaaacataaatccattcgttcattaaataattcgataaatttctgttcattgaactgtgttccaatataagaatctaacgcgatgcgaggaagattcaatgttacaacaccaagattattacgtccatcaagaatttcattgccagtcgaatctttccatacgctcaagaaactacggcaacccattggagaaacaggaacagatgaaccagtgatagctttattgttcttagctgaaataatatcaggatacatccttttgcttgcacactctagagcaagctgcttaatatcatagttcggatcgtctttataaagattaacaccttcttcaacgaacataacaagcttagggaaaataggagttatcccatcacgaccgagacctttaatacgatttttcagaattgctttctgaatcattcgttcagtccagtcagttcctgtaccaaatgtaattgttacaaaaggtgtttgtccgtttgaactaaagagagtatttacttcatattcataagcttggaatgcatcgtatacatctttttctgttttagattgagcataattcaacgcatcagcgatttgccatttttctgcatcctcaatatgttttgcataggtgcgtttaacataaggagaaagtactttatctacattcgcaaaagtcgttccgccatattgatgggaagcaacttgcgcagtaatttgtgccataattgcagtagcaacaccgattgatttaggagtttcaatctgtgcattaccaagcttaaatccgttctcaagcattccttttaaatctactaaacagcaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaattgtgttttagtgtcagattcattatattcaaatcctctttgaagcatctcagccatcatttcctcttttcctaaacgagaaaattcctttgatttatctccaacaaagttagggtgaatattattttgggtgtaatcggattttaaataagtaagtaaattttctaaccattcaagataatcaacaccttgtccctttaagccagaacgattaaatttatgcttcatttgaccttctgcggcattgcagagattacaaagcaatccacgtacctttcctgcttttggtccatttaattcatggtcatggtcaaggtgattagcttgaacatcaggatttagttctcgttggcaaattaagcatttaccgttttgtgcatcataaaatttctgtttttcttctttatataatttgccagtcaataacataataaacccttaccttaaatagataagggtatttattattttcaagtattgtaaaacatttgattcaatcgcttatattgccgaatcttttggtcagaaaaagaaatttgattttcaagccattcaatgtattctgcggcagcttgcatcaggttaccttcatagccatcgttattttcttgcgcagctaatttagctaatgcgtatggaatacgttcaccttgaaaatcggctttaggcttctgaacaacttgattagttctctctacaacttcttcaatttcgccattttctactgattcagtattccacaagcaccaatacgtagttggcttatcgtagatgttaataatctttccatcagaaagttcaatttcaataattccagtatcaggctctatatcatcttcgcattcttttgcaagttcacgaactttaaagacagtacctgcactaagttccggccagtaattacacagccctgtatcagcacgattaattctaaaccacttatctactgtaatcatgtcccatctccatatcaattaagtcatttatcgttggttcattatatattgtttcttcatcagtgtaaaccggttcttccggctctggctctacagtttcccatctagccgcccaccaaggttttatagcgtaatccattctcgtactgtctgagttactacacgttcatggggctcgactagttcaacagtcggaactgcataataccagtcagaatgataagaacctgaccgagattcatttacagccacatgtacattatgttttggactaaaataaacacactgacgatattgacatttgccgtcttgtacccagtcttctatttcgacaggtttaagataatcggaaaaatcgaaatcatagttttccgaaaatgcatcatggtcttcaatgatttcgctcagaactgcatcaacatctaatttattttcaatagtcatttttcaccaattaatttcgcaatttattaagttcttcatcatcaatccaggattctagtcctgatggcagggcacattcaatttcccaaagaagttcttcaattttatgaagacgatctagttcttcagcaggaatagtaaccattgacggagctcgtgatacattaatatcgtaaatcatatttaccccaatttaaccatacaatcgccgtatttccacttagaaatagacttttcaccattagaataataaacttcgagtttagcacgattatttttaatttgaataaccttggctgtcatcaaagttccatacccataataaactgcaacttcatcacctacatataccgcgcttccgcgataatcatgaatataatcagttccttcgagcatcatttaaaatattctcgcagttggtcaaatccaccaatatgacttccatcaggagcaaatacctggggcattgttaagccgatttgagtatcacgacctagtttagtcagaagctcagcgattttctcatcatcaaaaacacctttttccggcataatgttgataaattcaaacggctgtttcttcacagtcaaaagacgttttgcattatcgcaatacacgcatttatgaatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccatgttcattataataagctattgctaattcacggactgctttttcagcagcctccatatattctttacgcttggtcattttcttctcggtcaaatcggtgtttacaatggcgacatttataacgaagattactagtctgccaatgaactaattgtacctgttcagtaccgcattcaggacatttaggaacgtttttagaagccctttcgcgacgttcaaccataaccataatggcatcccaagcaggaggtttaaagtctaaatcgtcacaaccatgaatctttccacgcatttctagatcgtcttcttcaccagccataataattttaattaaactggaattacttgaagctgcaatgtcttctaatagacgctttttcatttcaatacctcaatagcattacgtaaaccatttgcttttgcattaagagcttttaacaatttggtgtgttctgcaatttgggcttcaacttcaatcaaacgggcattgagatattcgcgttcttcgctcagattatcaaccttttctactttaggctcttttacaactgtcttatatgtattagggttcttcagtttaattagaatgcgtgaactatataacattgaaccgttatcttcggtttcgtcatacatttctactacgtccatgatttttaacatcatgcgaagtttataagacaacgaacgaatagttttgttgtgcttattaatttctttagctgtcatggtgccgagattacgtgagtaataataaggaacctggatattaattaatactgatgaaccacctggcttgtgtgttacttcatcagcaataacccagtccttaacgtgaactgtatttgtacggtcatcgcccgcggtaaatagtttgcgagcatgcttaaaaagcatattcacttggtcattgaattgacaagcaaatttatcagcaaagttagtttcaggaatggtagataaccaatcagccaaatgggtctttttaacatcgttaacaatagtaaattcaaccaaatcggttatagatgtctcagatttaatgaagctcggcttcataaagtttttaatgttctcacgagctacagtagaagataacatacgagaacgtttaaaccattcaagcaaattgcctaacgaatgagaataagcgttttgagtatctttacagatatgattttcctgaccaacatattgaaggaaatcacgaagaatattattgattactgctctgtgcccgatctgataattacggtgtttagtaataagactgtcaaaataatcaatataatgtttacgagttttcatgttcttctcacttggttaatgatttatactccgagccatccttggctttaaattacttaattaactgtaaagcttgttctagacgatcaagacgattaacagattcttcccaaatccttttagcctgctcatattctttctgcgctttattagaaatttctagaacttctttataagctttttctagtgcaataacttctggacgaatttctaccggttcaggtgaatcgtcaagacattccattagttcctcaagggtagtttcttctttaggagtattcacaatttcatcacatttttgttggtaaatttctttattagtcggtgagtacgcgcactttaattcacgaaggctaattacaattttatatccttcccaaccgcatatattcttaaaaggatatgtatgaatattttctactgtttccatacaaagtaatgcagtctctaactgacgagttatagtgctagcaattgagaaaaatttattaatattcttttggttagcgtttggtgtaaaaaatccataattcacaaaaatagctactttattttcatcaagctcatattcttttacgataatcatatcagaagccaaaggatgaatttgacgataatcgccataacataatttagaagctgattttagaatttgtcctttgaaaagtctgaaattactaatccaacgacgagtaaaaatattctcagggtcttctttattattaagatgataagaattaacatcaccgaaccaattatatcctactacatctttggttcgtttaatttctttcccaaaattaccaagaatatcccgattaaccaaatatgaaagaagacgagactctttaaaagttttcttgataacatctttatctacacggctagaaattttacgaatttcatgaataaatttagtagaagaaacaatacttgcatcaacactattgagccattgattgataatagaaagaatgatattttgaccaaacatcggtatagctttatcatcaataacgctattgaatgatttgatatattcgttacgagtcataataatctcctcagtagaaagtaagaacattataccacatccttgtggcaatgtaaactagttcagtgcatttagtgcattgttcagtttagaacgttgcttcgtaagatttttgactttttcttgagctttttccaacatcttttcagcttctagcacttcattagttgctttaacgagttcatcatctactgccttgatagacttctcaatcgcatctgcatgccatttttcaacaggtttaagactcggattttcaataggaagaaaattcactttattaaatttccatgcatctttattacctgaactatacatccaaaatttaggatcgtttgatgagtaattagataaatttaagttatcttgcacttcctgctttttctcttgcgggacttcgtcctttctcaaaaaatcatatttaaatgaaacaaccatatcaagttcatatgttgttgtgtctaatttaaatcgttcgaaatgcggcgaaatcttagattgaacagcagcaacaacatccatatacttaaatgcttctgtcagctgtgatttaagacattcacaaattgaaagagaattttttgtattaggtttaaagctaattcgtgcagttctattattttcttttaacggtcttacttccatctgaagagtataaccatcaaatttcaaattctttaagttaatatcagagccttttaatcgactagcagtagacaaaatttgctttaattgtttacgaaatagagcaataaatctccattcaagacgataatgatttggattaaaaaatcctgttgataaatcaaccttactctgaccgacgccttgaacaaatagaggatttttataatcaatagttttacagaaatcggtgagctgctcacgagcagtcatttgtgtaatatatccagctttatcaaaatgacgtaaccattcactgctattcatatacttaaagtgaatatcacgattaactttatcagggtctaaattattttggcacaaaaatgtcataacatcacgagtatagctggcattacgaaccatatcttcaatttgagaacgagttttcatagtgttccttaagatttaagtaaatcaacaattttaattaatttttcacgctcagatttagctttactactcaatccagatagtctgaaaatttcatcgtcatactgttgaatagaaatattcagctcttcaatttgcttattaaaataatcaatttgttcagaatgtttttcgttactacgaactggtacaggttttgtaggcaatttagttgaactggattcatccgggcgataaattaaaatacaacttgaaccaattggacattttgcaccagatgaatattctaatgttccgacttcttttaaaacttcaaaagctaaacagagatgatgccccatattaacataatctgtagagcgagctctgatgtaataatcatctccgcgaatactaaatttaaagcatttaaggtcttctgtattattggtcttaaaaatcatttgtttatctagacctttagctaatcgagcgcctaatgctaataatcgtcgttgattttcccacaaatccgcaatcatttggtcaaatgataatttcggcattagtcgaccataaaggtcgtatcctttattataattgcgaaggatttcactcgcgttaatacgagacaatgctccaattttattaagtgctttcataatgcgattagataaactcattccagatccgtttgttcgctgtaaatgtttttctaatccaaatccaatatcaactttaaacttatctaaaatttctgcatgaacatctctgtcaataacattcaaatccaaagttgggttaaatctatgaaaaaatttatctggctctccacgacgaagtacagtccattcattcaattttttattaactaaagatttaattactgcattgacattattaattactactgacatattttcctcactcaatttcaattttactaaatatacagaataagatggaacagactatataagcaccacacacagattgaactaataccattccaaagaaccaaacaatattatcaaacaatgtctgttttacgtcgaaaggacgtaaacttacagtaatattatcacctttttctattgaagaatacatctccggtgaaatatattcgctaaatctataaccgtcatttagttcatatacggcaataaacgataaactagacccctttccttgagttcctgtaaaggtattaactacagtaacatcataatctttataatgcatataatcattaatagcataataaccatatgcaactactacgcataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattttggcgttcagctctttgctttttgtaagtttcaatacgctctgaaatgagagtgtatcgttcatttactgattctttcataaaatcaggaatttcacgagaagctttaatctcgtcaaatttatcaataacagcttgctcttcagcaattaagttatcatacattaaaatatctttcttgatgaactcaatatcttcttgagttacacgagataatttagatgctttatcctttttgtactgttcgttagtatcacgagaccagtgtaatgtacgatttttattcgtattcttgtaaatttctacaataccaatctcatcgataataacgatccaattccaacgggatttgtaaatttgtcctccatcaacagtgatttcacctccgattgagatgtcgttaaagaacttgctttgtgcttctgatttaaatttaccatcgttgtaatttaccaggttgaaaatatctttagcgttcattttgtgttcctccgtagttgatagttgtatagtaccacagaggaacggtcttgtaaacaactaaaagaaacttctttcacaattttttccactgaaccacgcactcactgctttcttagtctcaggagcagtgttatccataaaccattcaaaggcagcctttttatgattctggagggcttctcgggctttaatctgctcacggtctattaacactaacatatgagcctttcttgtcaccaagggcttcttatgattcttggagtattcccaatcatttgtccatcgcatcgttgttgcgaactgaaatactgcttctttaattttagtttcgtaaatttcacgagcctttgagtataacatcactacctccatttaccagtttaattctagtcatctttttaatggcagtccatataatctatttctgaactgcctttttgtcatagaaggcctcttatgaattatttcagaagagtaacctcagcaatttcttcccaaccatttttgtcggtcataataaagtcagcaagataaagagcagtacgcagtgaaacattgcgtaaacgattaacattgactttcatccatgataatgctttataagtttcttcatcagaaagaccacgcttttgcatcatgtcggttgaaagaataacatcttcaaccctgaccataatttcttcattagtgtgaacacccaaatctaaataaaccgagcgggaaactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagatgcagtgctccagcagactttacgggtctctccagtgtccagagcagctttcaaaagattaagaatgtccatatcagagaaaacatccacatcatcaatcaaaaggacagaattctcttcacgattattccagagctgttcataaagaccgataccagagattttaccgttaatgcttttatattcaatgtatccaatatcatttgctttatttaaagctttatctaaagaatacgttttaccaatgcctgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatccaccggagcattatctgggaaccattcacctaagagctcaaaagttccagagatttctttaccgaagtagatacccttattgatagttacagttttcattttattctccaaatccgtatcagttgatagttgtatagtaccataaagctttatgcctgtaaaccgttttgtgaaaaatttttgaaataaaaaagggagcccgaaggctccctatcatttataataacttcggtggttttcaagatagaccttctcaaggaagtcatcccagaaactcatgtctactgttttaggcataccgttcttagaagcttcagtagatgctgcttctacttgatcgaccacatcttccaaaaactcttgaaccgttttaaatggatgtttacccaacttcacgtcgagaataaatggagcatcttggagtggatagactaagtcaccagttttgtaaatttccaatagttggagtccaccacgacaagcatgactcaaagctttccagtcaataccttcattggcttcggccttacgagcacgttcaccatattcagcatctaatttgttcagtgactgcttaagctcaataagagaaagcgttgtctgatatttacgacccaacacagtgtagaacgtttgtgggcctgttttctcatgattatggaacacccattcacagaattcgttttctggaagacgatgcttaatatcttcaactttagtgcgacgctgcttaatagaaccatcttcttggtaatcaatccactgctcagggatttgattaactactttcaatacatcacgtaatgcagccaaacgagaacctttaacaccgtatttagaagcttgcttgcggacatatcctaaatatgatttcatgttagtcgtataaaaacgagaacggttgtcttgaataaacttccacacatcaggcaaatcagatttaactactagttcaggtggagtgtggagcatatccaatgctacagtttcaccatctgctgctaatttaaagaaatatttaagactgtatagttcatggtcaatatcatctttagtgtttttagatgatgtgttgttagtgtttttgctcatatgctctttaacgtttccgataagaatatcacgagcaggaggaacaaaaatttctttaaaatctacatccgattctggagtagaagttccataaagatgactaccaaaatagcttttcattactgttttcatcattcagccttatattcaataacaggacatactttagctttacgagcttttaaaaattcaacgataatcgatttcttgggttgaataggctcaagtccatttttgattcgttcttcgttttgtataatgagttcaatttctttattgagctttcggtcgttatatttgtctaacaaccaggaaggaccaattaccgccgcgactgcaataagaaccattattgatattgttaaaatacctataccaattgaagccggaactaatgtccatagactactaaagacaaagaatttaattaaaatttcttggccaatgattgcggcacctgttaaagttgcaaatccaacaattgaaacagctaataccgggagaaacgttttccaaaaataagcacataacgtttttggacgattccatgtgctgttaaatgccgagtaaattttaaagtgccaagagttttcattaataatcataattataatcatcctttcattgaaggcgtaacagttgttaaatacttaatcatagcttcagcttctgattttgataatgaaatttctccattgttttgacgaatagaaataaaatccggatgacggtcaccaccagcttttaaaacacacatataagtatcagtttcatcttcaatatttgaaatgattgaagcagttccacatgaatgcggtttttgataaatcaatacagcttttcttccgccatttgactgttcataaacttttaatacatcaaacaaatcacttcttttatcaatagctaaaatgttattttcatcttcaatgttaaatccttcggatacttcataaagtgtcacccataaatcgccaatatcaataacagcgttcacttttccatgactttcaagagcatgacaaattttcttgatttcgtcataactcattttaataatatcatctccttgactaaggaagatgtcatttttaaattcaacacgaattaaaccgctttcacttgaaataaacatatttcctcactttgaaatcatagttggaataacagaatcaagataagtctttagtgcaatagcttcgtctttggtaaatgtgacaatatgtgctcgagaatcatcaatttggcgaacaagtacgacatcgccatcttcataagaagtcttgacatccaaagtcgtagtataatttgcagctactggattaataatgctagcaccgcgatctttagcccattgaagtttagccttttcgggtgtttcgactgtttcagattctaagaattctttcaccttggaaacgaatgttgcccaattgttgatagaaagacacataaattcagtttcaatattaccgccgtaaaggccacgataaaaacgaacttggaggtcgcctgtgatattagttacaccggtagctcctgagggagcataagataaaatcgcagccagttccataggaagaatagtaatactatcgtcttcctgcgtcagaacgtatacattatcacgtttttcgataaccaggtcaccgaacaaatcagttgtttcaattacagctttcatattatttaccaattaaagtttcaatataagaatcgagatttactttagcttcttccataagagttttgtatttaatcttgttggcatgtccggaaaaagctgattcatcaataattgttgatgtatgaacagctttactatacgtctcaattaattctcttaatttaaaagcctgctcacttgtcattacatactcctctgaatcatatcaataatattgttcaccagattataagtaaacattgggtaattatattgaatcatcacatacacaacaaacaaaactttcattctcttctccttggaagttgacaagattactataccataaccttgccaacttgtaaaccattaaatgacgttttcaataaaattctgaagctttgtgtgagcatcaaccatgattttcatttcttctttggcgaaagctgtacctctttcccgagaagaacattcatagtcagaaactgcattagcatattcttcaattagtttcattaaaaacatctgcttttcagttttcattattccacctaatcatttcaagatattgaactaacttagctttagatttatccaaatcctttttagctgcttctataccgtcgtatgaatatccttcacaatgctcaactgctaattggtatgaatctatttcaatatcacgtgctaatttaatgattttttcaaactgttcacgtgttagcatacttaaactctcgtattatgatcgataatttcatcaagaaacatatctaacgcttctaaagcattatcaactttagcttcaagttcatcaatgcctttatttgcaatgcctgacgaaaaccaagcaaagtcactaagttcctcgtctgctttacgaattaaagctaccaattctttaatcttatccgcttgttcgatactaatcattattccaccacatatgaaagagagaatattgcacacgccatgtgagttgcaacttcatcacacatattataacgtttcttaagaagttctacaagttcttcactagtaacttcatccatgtcgacgaaaaaatcaccattaatgatgacgtagatatttccttcttgattaagtgcttcaattttcatgatgttctcctctttatccgatggttgtatagtaccacggctcagacggaaagtaaaccggtaaaatgaaaaaagtctcccgaaggagactaatgttattcgagggaaagaagatacttactctggtaaaacattccagtaatatcatctatcgtgctttgaatggctggaggcatttctttataaatgctgttagattggtctagtatgcgatcaatcattttaattgtgtcggtaggaagtttactggcatctggaattgaaggtgtgtattttctaccagaataccccaaatattgctcaccaaatttatcaatcaaatctggcaactcggagaaaataaaatcgtatgctttgtgtctagcataacttttagtttcaaaatgtgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgttctatacattcaaaatcagaagagcacgggtcattttataggtcgttctcataaaactatagaattgttcagacgattctacgcttttattttcaaaaagcatataaacgtgcctaataccagattccataaatttatcaaaatgaggatcgacattcgcttcaatcgatggagataaaacaaatgacaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagcacagtaagattgcgaagttgcttttcagttaattgtagcatatatacccctttagttagataaacctatttataacttttacactaaccgagctttttagttaattcattccaatgttttctgcacaaagaaacataaatttcatcaccaatacagatttgattaccttctttaactggtgttccatcttccattaatcgagctgtcataatcgcttttttgccgcaatgacaaactgcctttagttcaataagtttatctgcaatcgctaaaagttctttagaaccttcaaacaattttccagcgaaatcagtccttaatccataagccataacaggaacattatatgtatcaacaattcgacttaattgatgcacctgttcagtttttaaaaactgagcttcatctacaaatacgcaatgaatatctttttgtgcttcagcccatttatagaactcgaaaatatccatatcatctgtaataatattcgcttcctgtttaattccaatgcgagaaacaacttcacagacagaatcgcgagtatcaatagcaggcttaagaactaatacactcattccacgttctttataattatgtgcagcagtcaaaagagaagcagattttccagcattcattgctgcataagtaaaaattaaactcgccatatcaccttcttaaagcgtattcacataagctattaattcgttttctttcttatcaaaccgatcagcaaattcttcctgctgttctggagatagcgggccgtattcatcataaaaagtgtttgcttctatatgctcatctagaagttcatggataagctcaaacaatttatctttttgttctttactcagactcatatatattaatttccaggagttttaaaataattcgcttttgcttaaatatttccatagttaaatgaccagtatctttttgaccgattccaatggcaaaacctttattaacagcgagttcaattaaattatcaagctcacgtaacacttcgtattgtaactcaaaattattcattttggtttaccttctttaacgaaatcaggataaggataaaatcctgaataaaatccttcacctttatgattgatgcatcctttattagaacaatagcaccaataatcgaaatcacaagccatttcatcgttgcataaagcaaaaacaacaggccacttacacttttcacagtgggcatttttaagaatactagtttggctcataaccatgtaacctttaagcaatattcttctacatgttgtttacgacctttcttatcaataaaggtatattcaacgaatgttccaatgtagtctttatctacatcatgtggactattaattggacatttagtacggcaaatgcgttcccattgacgaataattactgctttgtttttaggatcaaacggatgcgggtaatgtactttcataatccaccactattaaatcaatatcaggagtaaacatgtcgattaatttagaaaccttatcccaatcgccgccagcaataccacaacctatgcgtggaatgtaaattaccggtttaaacaaaagggtttctgcctgtagatttaattctatcatgcagtttactaaagcaccataatcaagattaggacctggttcgtattgcgtatacaagttataacatatgccaaaaccattaggtttatgtttaaaaacaatagacatatcgcctaatttatcacgagaaccgtactcagtagtggttttatctatttctaaaattttgggataggctcttgctaattgacccgctacacctgaacccatagtatgaaaacaattgcacccgtgcgcaataatattaccttgaagaaatagggcgacaatatcgcccttgatatattttacaatcatctagtactcaatcctcgattataagaatctaccaaacggtcaaccattgaatgacaagcggctttatctttctcctccgcaactgaacattctaaggtattccactttttagcatatcgttttaacagtgtatcatttttgtatctgcttgatttatctctttctccgtctttatatgcatatattaatttctgcgcaaattcagcttggcatgctttatttttcccgcaataatccgctgcagtacggtttacatactctctaatttcagtatatgatgtatctgctaacgcagaaaatgaaattaatcctatacataaaaccaaaattttagtcatttactatttccaaaagtttattatttttaaggtaattagccttttctaggacttcagaagcatatttagaacctgctttaacattccatcccgaattataagaggatattgcttttcttatatcgcccttatgtatatttaaccaataagaaagttcaatgtacgcccaggaagctgaattggaccgttcattcaacattctttttatttcagcatcggtcatattataaccaagttccttaactcttgctcgcatagtaggcaaataattttggaacattccgtaggcgtgatgctttggtttagattttaaattaactccgccagagctttcttgccataaaatagcagccattatatgacctaatccgctcttgtggatatttttgtgtgttttatattttccatccttagaaaactgttccccgaattgatacgcgtaacgcatgttatcgagttggacattactgaaagtacgctcggagctatgcgccatcattgaaatggccaatagaccagcgagtagtgcttttctcatgcttacctcattgagttttaattactgctttagaagcctttcctggtaaacgacgactgttgataattgccatcctacattgaagtgacgggtctttgaacttcgcattaggtttacaaactgtaaatccaagccaaagatttccatctgtgatttctaaacgtccaggacggtattcaaccccatcaataaaatcctcgtcaatgtcaggacgcggaggcatactcaggaattcattaacttctaaaacatggtcttttattttgtggaataattcaaaaacatatgtcgcatcaatctcccgttgaattgcacgatcaagaagatgctgagaatattttagatgaaacgatgagacccctgctgcttttgatgcctcacgaatctcattgttaatttgacgaaactccgactcaaagtgacgacgaagcttatttcgacggataaaaacttctgtgttgatagtcatgttattctcctcttaactgatagaaaaattataccacagtcaagaggaaaagtaaacagttattctttaaatctaatcaatttattcatagactttgaaacttctgcacggacctcatgtaggtttttaagctgttcaagacgttgctcatagtaagcaatttcatcttcttcaagacagtcctgtgaatcttctttaagataacgtgcatagtcctggaaagctttacggactacttcctggaagtcatcaagactttgaattttcttaggagcaacagatacacgacgaggggcagtataatactcataaccaaaccctgcgcttaattgagccattaatatttttcctctggttggaacacagcacgacaagcccacatactggcttctttgagtttcgttttagcaatagttaactgatcgaggctttcggcgtaattcttcgcgagttcatcatcttcacagctatcaaatgcttcccaaaattcatcgtataaagcatcaaagataagtcctaaacgaacttcagcgtctttaatagcatttactttaccgattttttcgtcagtatgtggcttataacctttaatatcttcaatcatatttgacttcctcaccagtacataaatcatattcaactaaacgaataggttcatgaatgccatatccttgaacagaaatttctgtcgtaggataaattccattaatatcacccatattccatgcttcattaaattgctgttcgcctgaattactaaaccactcggcgaaagcatttagcacatctttagaaccttcaataattatctttgccattacaaactctcagtaaaggtacgagcgataacatcgcgctgctgttccggagtcagagagttaaagcgaactgcataaccggatacacggatggtcaactgcggatatttttccggatgcttaactgcatcttccagagtttcacgacgcagaacgtttacgttcaggtgttgaccaccttcaattttaactgtaggctgtgattcaatttcaatttcacgggtgtgcaaaccgtagaaaatttctgggtctacaaaagagtcctctttaaaggttttagaaacaataattcgtgcttgaataccatcttcaaaataaatagtacctttatgtgtgccttcaagaatttgatatgctttcatataaacctcaattagaaaataaatttatccaagattgttctttaattaaaaatggctcagaatcatatgccattaaactttgggtgattagtcctttaaaaggcccatcaataaattccatggtaaaatatggaattttattcattagccgtgcattaggagcagtacacaaaactctgcatcctttgaatacgcctttttgtaatttgtattgcttgggataaaattcgctcaaaatgttattatttgctaaaatttcaaaatgattcaccaatttatttttaatagtttttggcgaaaaataaagatattcgaaaagctgagtgtctgtcatcattgcattccgattacgaaaaactgtggacgagtaataccaccaatgcaacatttactattgcagcagtgttgcacagtttcaatatgaatatcgtaaattttatccatatcaggagatttaacaggctcatcaattatatacaaaattcgtgaaagcgataaacctctgaacctgctacctctattaccaacaaaactacggacagaatcagtaaataaacgaaaacgtatatcatcattagaataacgcgaaaattcctttttaatgtggcccgcagaaattttagcgtaagctgaagtattagaaagaacaataactgttccgccatcatacaaccaattagcggcaaaattagttactgcagttgatttaccggattgacgtccaccatctatacgaagtgtgcagtactgtttaagtaattcttcaaatggcgggatataatcgtttttacaaatttcttctactctagcatcagaatggtgtgtaaaagcattcatcagggatagataaggaccagttaaaaatgttctcattttattctctctaaatttgggccattccatggcgcatgaattgtccatttctgtatttacccattaccgcacttgggctcgaccttattacaggttggcgggaatccctcacaaaattatgaggtccaggttgttcccatattatttgaatgatttaacgtactgaatagaacccttactattcacgaaaacgattttaccatttttattatacatggtagcagtacgttgatagccataagtttgtttaccagattgataaccaactaatgcaaaattatcttcacccattttattctgtttagcgcgaatacgttcatgaccgtgcgccataagaaccttagcatcaccagttgcaatggatcgacgagttttttcatcttcaactgtattaacaaagtcgtcaaatgaatcaaatttagcatgagatttattatacagttttccatctactgcataattatatccttgtacatccatctcaacttctgtaccatcatccaatacagcagtgattttttgaccttttttaaatttcaaaagatcagtaaaagattcagcaataatttgagaattaatagctgcttcagtaataaattcttgatatgttttcatgtgtatcctttaaatgtaaaaattttaattaataatttggctcttcaaataactgtgaatatactatcacaattctaggagaaagtaaacaactttatagatttttatacgcgtcccaagtgccagttctaaacgtagcaatgactcgttttgcgcggttaggtgtttgattataccatctacttttagctaagttaactgctgcttcatcccaacgtttttgttgaagcatacgtaaagagttagtaaatcctgctacgccagtttctcccatttggaagaccatattaatcagtgcacaacgacgaaccgcatcaagagaatcataaactggttttaatttagcatttctcagaattccgcgaacagcagcatcaacatcctgattaaaaagtttttcagcctcgtcttttgtaattacaccattgcaattacgcccaatagctttatctaattcagatttggcaacacttagtgatggacttttagtaagcaaatgaccaatgccaatagtgtaatagccttcggtgtctttatagattttaagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacaccatctttattttcaaaataagactcgcaatggcaatttctaaacatctcatgctctactggaatcgtataataaaacagctgtaagtctttattactagaatatttaaatacacctaggtcttctagaaggtctggattataattgctaaaaccggtctcttctaagcattctctttgtgctgcatctagtgcgctcaaatcagaattttctacacggccttttggaatatcccaacgatgtgccatcattccaggcttacgagaaccagtaacccgtcccatgaataaatctttatcttctgtcataaagataataccagctgataatgttttcattttaatttcctgcattcggtgataaaattatttaaattttgagtgtatttcttttcatcaaaaatcttttgctgcctacgtaaacgccatggcatttcaatgaacacgcaccatattcctgatagtactgctgctgtaaaaatattaacaagtatgattaaaagaatccaatcttccgttctgcctactgggctttctccaaagaaacaaaatacaaatgatgtcacaggaaaactaataatataccacagaatcatagtcttatctgtgaaccaatctgcgttcgttaatttagcgcgaccgtttcgaatacacacgaatttatcatctgttgcagtagatggcttaactggttgatatcccattctaaactccctaatcagcaaatttttcatatcttcggaacagccattccagtcaactctatcaactgaaatgccatcatccccatcatctaaatcataccagcgagtttttaaaatcatttgattttcctacaatcattcacgaattctttcattgattcattttcaatataagacatgtagttattatattcttttaattgtattttgtaatccttttttctttgccaatttattttaaaattatcataatgaaaatataaaataataccaaagaatgaaaataatgaaatcgctatagtataatgaagttcactccaaacttctattatatctactataccgctgacattactgcggatgtttaaaataatacagtcaatcattaatccaataagactaccagcaagagctgcagccaacgccacagcaaaaattaaaaatgactcagaaaaagaatatttgactttatttagttttggcttttgcatcgtgattccttaacaaatttcataatttcgttaaattcatgcatatctaatttaagctggtgttcctttttaatctttttacactgagctttccaatcacgcacgcgtttacgatagtgtcttccttgataccagtatcctatccaatttataggtactaataaaagcggaactaccaacggaagaattaatactaacaaaaatattacgccagattcaatatcagtcataaagtctataaccattccaacaaccaatagaattacaaatgatatagctgtcacaggacctattaatacatcagtaggaattagctgacgctttagttcatacttcacaggtttacttggaaggtatagtgatggctttgacatattctctgcattccttaacaaatttttctaataataaatcgctttcaaaattgggattttctacgaatttatcaaaaagattatcgacaatagttaagatattctttttactaagaatacgtttattttcatgcttcgtttcagaatcaactataagagtaaagaaatatttcttgccctgaaattttacagtagtatcaatatagaataaatttgacttttgtaaattacgtttaaaccatgcatcacttaaactataaacgccaagataatcataatcgtcgtttaaataacagaccgtccattcaggagaaacaaaatcagtaaattcaacgtcaaaatcgcatgttaataaatgaattgattcaatactgttaataagtattccaggacgtattaaagactttttacctttataaaatccagaaagactttcatcagtttcatatgaagaaccccaataataattacgtccttctgccatacgtttaagagcatttaataattggtctggaacatcaacctgtctttggaactcttcaaacattgaattgaaatcactttgcattttcattcctacttactccaagtaataggggccgaagccccttatcattatttcagagaattaatgtattcctgaacatcggcagaggtagtttcaaccccagaaatattgccattaaaggtttcaactcgagcaagagtatcttcaatatcaaccttagtcagtgctgcaatttcaactacatcatcagcagtactaattccgagagcatttgctgcgcgagtttcacggatatattccaatttaactgcaagttcttgacgagcatcatctaactcaactactttcttggcgatttcaattcgcatttcagcatacccatcagctttagtagttaactgttcagctgttcgacgatatagcaagccgagtttagcatgcattgttacatcttgaccttcagaaaggagcttgcgaatttcacgctcttttgattcggcctgcttattcttttcgacaataagttcacgaatacgcttttcttcattaatagatttaacagaagcagtttttagatctttaatcttatcaagtagttttgctgccgcagcagtatactgttcttcaacagatagatttttagccatagcagaaccaagtttagtgcgaataaactcaacaattttcttcagcatgttcatagcatttcctttagttaattaagggttttataatccgtgggagtattatactctactcccaagagtttgtaaacttattcttcgtccaattcatcaataaatttatcgatactactattaatagactcatcgatgattaacaaagcatcatcatctataatattaatattttctaaagcatcaatataagcttgattgactatagaccatgccctttgaaaatatggggcttcatcatcaggactgaaccaacgtacaccttcaaagatacgtttagcataatccaacacccattgtacaggcatgttttgagagcgttcattaaactcttcaaagtccttagattcaaaaagctcttcaggataataatttctattacaaaaagctttactaaagttacgtttcataatgttctcctcaaagttataggctcataatatctcaatcatgagcctgtgtaaacttatttcatattattgaaatattcttcagcaatttcatcattatcatgataaactttagaagacagtttaacataactttcagcagtgaacatgttaatcacaacctttacagtataccactgaccatcttcattacccattactgcgtaagtttcaaacaacggatgatcaggaccgataactttaatatcattcactgtacgaccgaaatcttctgaaacacatttcataaagaagttgaacagctcaccgtaattatccatttcattctccaagttgttttctgtatcagtagttgatagttgtatagtaccatggaaggacaaggatgtaaaccgttttgtgaaaaaatttttaaaaagttttggggaattctagggcagggaggggaaatcaaaggataggataatatattataaagggtataaactaaatgatgcctagagaggcccggaaaagcctagatgccaaaaagccccaacctttctgtcggggctaagaatgttatttgatttgtttagcagaccaaatgcggtctttaataattttttggatgtcttcaacatattcaagagagtgaacatgtgggttatctttgaaactataagcacgagctagcttttggccttcagttttaattactaaaagctctttaaggatagcttcatatttggagataattcctttaacaatatttttctcttgtgcgactttaggatctgctttagtagcaggtttacctgaagcctttgcaaaagcagctccagtagcaactagacttttccaggccatactaactgcattccctgtaaatccttccgctttcatatcgcgagcaaattggaatcgtgactcatcagaagcatctttataggaatatttacccgcggcaatggcagcttttgcaacagcttgaatttcggtgctagatgcttcatttaacacctcttcatttaaaaattgagcatatgatttcatcttatttcctgttttaattcatggttttaatatacttatttataccaaaaagccccaacctttcggtcggggctaagccttgcggcaaccttgtcggggttccacctgctaaggcaagtgtttgtacgaaacgccgggattcgaacccggttattaagcagttgacgctgcttaatatttttaaaaggccatatctcgaccatatccgaacgttccgtcaaaaacgctactcggcttacggcaaagatatttcctcgaatcgataattcggtgcgccgtttctgctgtgatataaggggacattaaccgatcgtaaagatttgttaatgccagtccttacccagggaacatcagtccgacgacttaccagtagcgacccggcttcttgtttggtcgaggcagtagggatcgaacctacgacctaggacttagaaggtccttgctcttccttctgagctatgcctcgtatttggcggacgtgataggattcgaacctataaccaatcgcttaacaggcgatcgctctgccattgagctacacatccaaattggtggggagtgatggagtcgaaccacccgagtcgcaatgacaatggatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccgctctgccacgcctccagtctccatacaaggatttgaaccttggacctcctgatcccaaatcaggcgctctaccaaactgagctacacggagtaaattaaattggagcggataatgagaatcgaactcacatcatcagattggaagtctgaggtaatgccattatacgatatccgcaaatttggtgcgagaagtgggactcgaacccacaaggaaatcattccgcagcattttaagtgctgtgcctttaccaatttgaccattctcgcgctgggaataaaggactcgaacctttgcatcctggaatcaaaatccagtgccttaccaacttggctaattcccaattattaacaaaggctcttaagcaagaacccttgatgatagagggtattaatcagtgcgatatgagttaataataacaaataattcttaaagcatatttaccatttatgataatacatatttacgatgcattcaagacccaaaggattcttgaaaatatcatattcaagaggacctttttctgtttcaataaagaaatcaaaatttactgtattaaatttacggtcttcctttactaatttaacttgtgaagatgaacggtcaatgtaaaccttttcaacttcaaaatatgttaaaatgccataatcatcaatcaaggctttagccgcgtcttgatcatatttatatccattttcaatggacgatactttcgcataaagaatcattatcaaccttcatcaacaatagtatgcgtattggcatttacaatttgccaccaatcaaagcgattggaaccataatctggtttgttttcattttctttgataatgtcacggagttcatcttcagtggcggctttcgcgattaaatcagcatatccaccacgaggataataattatcacctgcaaaaagtaaaaagtttggtttaatgttattgaactcttcaagagtaataacctttcctgacggttgaacaatctctacatatttatatcccaatttttgagcagcatctactgcttcaagcaaagtatcatgagcccatccaatttgacaacctggcttttcagatggattagcctgataatccgcatacactttgtacattctattcacctttagaaattttatccataacgatagcaattaaaccaattaaaaatgctactacaagtgaaaacacattttctgctgtagtcaataatccgcatataaatccaacaaacattgaaaaactaaaagcagaagcagaaattgcaatagcaacatttcgaattaattcacaacgtttcattttattctcctcggtagttgatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccggtgtaaataaactcaacttttacatcagaagattcagcgataaactctttgaaagttttcattttgatttccatttggttttgttttgatagagtaatagtatcactactaaaaccctgtgtaaacaactttgtgaaattattttaaatcttctaatcgtttcttcatcttagaaccatttttagcaatttctcctgcatctgagcataatgctaaaagcgctttaactttagtttggtctcctttaaaagatgaaggatcgactgcagcagcaagttctttaatacgagagaaaagacgctcagcttcagctaaagccattccaagctttacttccataccgtgggaagattcggtgatagtagtttttgtagcaaactctttgaaagttttcattttattttcctaattaattttgatgagataatagtatcactacctcatcaacgtgtaaacaactttgtgaaattattttaaatcatctgcccaatcaagtttaagaggctctttatattcacgatctaatacgaccggaatttgtacatcaccgctaaatgataagggcccaacattataagacaatgttatatgcggtgtgtaatcatcaaaatcatgtgtagcacctagtgcccgcgcatacatgtgtcgacagcgcagatattcagaatctagcacaagtacaagagtcgatccatcttgtgttttccatacttctaaatgtccagaagaagctacttcaaaacttccgcttgatggaacatacggaacatttactcttgaataacatatggtcgaatgaattttttctctaggaactggattaggaacacgtaaagagcgctggagttcttccagcgcatcaagtgttaattctgaaaacttagctgctacataaagacccgttgaaaagtctttaaattccattattcttcatcttttgcttcatcagcagattcagcagtaagattcttgacagcttcaacgatttcttcaactttgatagtatcgccagtgatacctactgcacgagcaatttcagccaaagttccttgcagaattttggattcttccatcagacgagccgcttggtcctgcgtatcaaggatacgagacttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgagtatcattggatttttgaccaggacgaactacatgaattactgtagcacccatcgccctagccgcatccatttcatgatcttgacgagtatcaggaacgatataataatcataacctgagttaaatttatcaagataatctaaagcaaataattttacccaatacatgcggtcgaagttattaacaatcaaatccgtacctagggcttgcatcagacgacggactgaccattgatcttcaatattatttataacgtcagcaatcttgttaaatgctacgaaattaactgcgtcatcaaaaacaaacacacctttaattgggcttttactattaagatagcaaaatgcttgttccataatcgtaattacttctaatttagtcagatttaaattagtttcacgatcatagtcaattccttcaaactctttacgagttaaacaaggatagtcagtgtttgctgcaaatacaccccatgcataagccaatgcatctttaataggaccagcaagttgatatttaactgcagaataattattcatgataaaatctgcagtagtatcttttccactacgctttacaccacttaaaaagattagtttcatatgtttctcctcaaatttagttaagattataacacatgaaactgaagcattaaacttctgctataattttaccatctttttctacttgaaaatacgtataaggaatcgttgctgtacatactaaagccgggtctgaatcttccgtgtagctaaattctacttcagacaggtcagaaacccaaggcttataaaaatttattgacatcacgatttcagttttactattatctaaaatgtaaagcgtaatgtattcaggacctgttttttgggcagtattttcgcctgtaagatagttactagttcctaacatccattcatacattcctatccacgacttaagctcttcatcaactataaatctcacgatgagtgggtcgtactcaaatgtaactcctggacgttgtgctctgcccagtccaaacggcccagtcacggtatcagtaacaggtatcctaattcctggaataggaactgactgagcatttaaagtaaaagcagatgtagtattactatgcggtattgatactacaaagttagttgtatttgcttggttaaaaatttgttgtagtgcttgcgacatatattcctcataatgctttataagtgttggtggtataatgggtctaagtcccttccattcaattccaattagaacaaacaatagaaaagaatggaagataatagaattagatatttgaccagactttgtttgcagagaaacgttttccttttgaaacgaactgctgaagtggcattaacacaacgttcgcccagtctttcggggcgatttcaacgaggctacccataatattaccaggtatatatgccttaatcatttggtctgcacccctaaatcctttcacttgactccaatcaatttttaatttcgttttattagtaatagtaggtgtatttgaatattgctttaaaagctcttctagaaattgctgacgagctttaggtggaatatagtgcaagtttaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcacgcaatgtttgcctgaatgaatttatcataagcagttgtctttcttgcttattgagtttattcattggttttgattcaagcttttgaatcttttcagccgttttaattcctgaagcatattttgacattgccgaagtaaacgtagagtatttgattcctctttcttcagcaaattgctttcctgtcattccttttgctttggcctttctgtattcaagacctatctgaatccatttcttttcgtttaatgattgcttaacctttggaacttggggagtgctttcattaattatttgaaaaatagccattatgcccccttaaagccaagagctcgtaatccatcttctgttagaattctaaattttattccacgcttttcagctaaagattgtgctgctttccatttgtcagtattaacagaatatgtataaatttcattcataaatcttttcttcgctgcggttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatattttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactatttcaaacgcgctcttgcgggatatcgcttacgcacttactatatcaaaggttcaccacgcccggaagaattagcaaatgctatatatggaaatccgcagttgtattgggttttattgatgtgtaatgataattatgacccgtattatggatggattacttcacaagaagctgcttatcaagcatctatacaaaaatacaaaaacgtaggtggagaccaaatagtatatcatgtgaatgaaaacggtgaaaaattttataatttagtatcatacgatgataatccatatgtttggtatgataaaggcgataaagctaaaaaatatcctcaatatgaaggagcgcttgctgcggtcgatacgtatgaagctgctgttcttgaaaatgaaaaacttcgtcaaataaaaataatagcaaaatcagacatcaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtttgcatccacctcaaagagcccaaggcgatgtaatgggtattccaactgataaattaccatggatgtcagttattcaacctataacttctgcagcaatgtctggaattggaggctccgttactggtccggtagaaggaactagagtttatggtcattttttagacaaatggaaaactaacggaattgtccttggtacatatggcggaatagttcgcgaaaaacctaatagacttgaaggattttctgacccaactggacagtatcctagacgtctaggaaatgatactaacgtattaaaccaaggcggagaagtaggatatgattcgtcttctaatattatccaagatagcaatctagacactgcgataaatcctgatgatagaccattatcagaaattccaactgatgataatccaaatatgtcaatggctgaaatgcttcgccgcgatgaaggattaagactaaaagtttattgggatactgaaggatatccgacaattggtattggtcatcttatcatgaagcagccagttcgtgatatgactcaaattaataaagttttatcaaaacaagttggtcgtgaaattactggaaacccaggttctattacaatggaagaggcgacgactttatttgagcgtgatttggctgatatgcaacgtgacattaaatcgcattctaaagtaggaccagtctggcaagcggttaatcgttctcgtcaaatggcgttagaaaatatggcatttcagatgggtgttggcggtgtagctaaatttaacacaatgttaactgctatgttagccggagattgggaaaaggcatataaagctggtcgtgattcattgtggtatcaacaaacaaaaggccgtgcatctcgtgttaccatgattattcttacagggaatttggaatcatacggtattgaagtgaaaacaccggctaagtctttgtctgcaatggctgctactgtagcaaagtcttctgatccagctgaccctcctattccgaatgattcgagaattttatttaaagaacctgtttcttcatataaaggtgaatatccgtatgttcacacaatggaaactgaaagcggtcatattcaggaatttgacgataccccgggacaagaacgatacagattagttcatcctactggaacatatgaggaagtatcaccgtcaggaagaagaacaagaaaaactgttgataatttgtatgatataacaaatgctgatggtaattttttggtagctggcgataaaaagactaacgtcggtggatcagaaatttattacaacatggataatcgtcttcaccaaatagatggaagcaacacaatatttgtgcgtggcgatgaaactaagacagttgaaggtaatggaactatcctagttaaaggcaatgttactattgtagttgaaggtaatgctgacattacagttaaaggagatgctaccactttagttgaaggaaatcagactaatacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgtttatacggaacgtatgaatctgtatttggatttggaaatgatgcgttgaaatatcgtttagataatgaatttaaaaccgctgcttcatgggaagaccttccaactgattctaatactcagttatatttatggaaagctcctcaaaacctccagaagacattcacttacgaagtaacattaatatatgactaccaagaacaaggtgaatctggaggttctggcagtaattctaggtcatcttctgatactactgaaccgacgaatcctccagctccaataagaaaaactcttgttaaaaattacacaaaaactatagttggaaattggagtcgttgggctaataaattgagaagctatgtgtatgagaggccataaatgtcaggattaagttatgataagtgtgttactgccggccatgaagcatggcctccaacagttgtgaatgctacgcaaagtaaagtattcactggaggaattgctgttctcgtagcaggtgatccaattacagaacatacagaaattaaaaagccatatgaaacacatggcggagtgacacaacctagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacgtttgctgaaataaaacaaaacctcattgaatggcttaatggccaaaatgaatttttggattatgattttgaaggctcaagattaaacgttctgtgtgaccttttggcttataatacgctgtacattcaacagtttggtaatgctgctgtgtatgaaagctttatgcgtactgctaacttacgaagttcagttgttcaagctgcacaagataacggatatttacctacttcaaaatccgctgcacagaccgaaattatgttaacatgcaccgacgcattgaatagaaattacattacaattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatatgttgatggagcggaatggattaactggacgagaaagtcaatggttcatgctggttcaacatcaacgatttactatatgcgtgaaactattgatggaaacactgaattctattttggtgaaggtgaaatttctgttaatgcttctgaaggagctttgaccgctaattatatcggaggtcttaaacctactcagaactctacgattgtcattgagtacatcagtactaatggcgctgacgcaaacggagcagtcggattttcatacgcagatacattaacaaatataactgtcatcaatattaatgaaaatccaaacgatgacccagattttgttggggcagatggtggcggtgatccagaagatattgagcgtattcgcgaattgggtactattaaacgcgaaacccagcaacgatgcgtaactgcgacagattatgatacatttgtctcagaaagatttggttctattattcaagccgttcagactttcactgattctactaaacctggttatgcatttattgctgctaaacctaaatcaggattgtatttaactactgtgcagcgtgaagatattaaaaattatctcaaagattataatttagcacctattacaccatcaattatttctcctaattatctttttattaagactaatttaaaagtcacatatgctttaaataagctgcaagaatctgaacagtggcttgaaggtcaaataattgataaaattgaccgctattatactgaagatgtagaaatttttaactcatctttcgctaaatctaagatgttgacatatgtagatgatgcagatcattctgtcattggttcatcagcgactattcaaatggttcgtgaagtacaaaacttctataaaacgcctgaagcgggtattaaatacaataatcaaataaaagatcgttctatggaatctaatacgttttcatttaattctggacgaaaggttgtaaatcctgatactggtttagaagaagatgtattatatgacgttcgtatagtatcaacagaccgagattctaaaggaattggtaaagttattattggtccatttgcttctggcgatgttacagaaaatgaaaacattcagccgtatacaggcaatgattttaataaattagcaaattctgatggacgtgacaaatattatgttatcggtgaaataaattatccagctgacatgatttattggaatatcgctaaaattaatttaacatctgaaaaatttgaagttcagactattgaattatattctgacccaaccgatgatgttatctttactcgcgatggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaaaacaaactcgggggaaaaactcccgagtaatcaatatcgttggattaatttaggatatacagcaaataatagtttcttttttgatgatgctgatccattaacaacatacattattagagtagctacggcggcgcaagattttgagcagtctgattggatttataccgaagagtttgaaacttttgctacaaatgcttatacatttcaaaacatgattgaaatgcaattagctaataaattcattcaggaaaaatttactcttaataattctaactatgttaattttaataatgacactataatggctgcattgatgaatgaatcgttccaattcagcccatcatatgttgacgtttcatcaataagtaattttattattggtgaaaatgaatatcatgaaatacaaggttctattcagcaagtatgtaaggatattaaccgagtttatttgatggaatcagaagggattttatacctttttgagcgttatcaacctgtagttaaagtatccaatgataaaggacaaacttggaaagctgtaaagctcttcaatgaccgcgtaggatatcctttatctaagacagtatattaccaatctgcgaacacaacatacgttctaggatacgacaagattttctatggccgcaaatcgactgatgttagatggtcagctgacgatgtcagatttagttctcaggatataacattcgctaaacttggcgaccaattacatttaggatttgatgtagaaatttttgccacttacgcgactttaccagcgaatgtatatcgcattgcagaagctattacttgcaccgatgattacatttacgttgttgccagagacaaagttagatacataaaaacgagtaatgcacctatagattctgatccattatctccaacatattcggaaaggctttttgaacctgatacaatgactataaccggaaatcctaaagcagtatgctataaaatggattctattggtgataaagtttttgctcttattatcggtgaagttgaaacattaaatgctaatcctagaacatcaaaaataattgattctgctgataaaggaatatatgttttaaatcacgacacaaaaacgtggaaaagagtttttggcaacactgaagaagaaagaagacgtattcaaccggggtatgcgaatatgtcaactgatggtaaattagtttctctatcatcgagtaattttaaatttttaagtgataatgttgttaatgaccctgaaactgcagcaaaatatcagttaatcggtgctgttaaatatgaatttcctcgtgaatggttagctgataagcattatcatatgatggcatttatagcagatgaaaagtctgattgggaaacttttacgcctcagccgatgaaatactacgcagaaccgttctttaactggtctaaaaaatctaacacacgttgttggataaacaactccgataaggttgtagtagtttatgctgatttaaaatacactaaagttatagaaaatattccggaaacatcaccagatagattagttcatgaatactgggatgatggcgattgtactatagtaatgccaaatgttaaattcactggatttaaaaaatatgcatctgggatgcttttctataaagcctctggtgaaataatttcttactatgattttaactatcgtgttagagacactgtcgaaattatttggaagccaactgaagtatttttaaaagcatttttacaaaaccaagagcatgaaactccttggtcgcccgaagaagagcgtggattagctgaccctgatttaagaccattgattggcacaatgatgcctgattcttatttgttgcaggattcgaattttgaggcattttgcgaagcatatattcagtatctttctgatggatatggaactcagtataacaatttacgaaatttaattcgtaacaaatatccacgagaagagcatgcatgggaatatttgtggtcagagatatataaaagaaacatttatttaaatgctgacaaacgtgatgctgttacaagatttttcgaatcacgtagctatgatttttattctactaaaggaattgaagcatcatacaaatttctttttaaagttctttataatgaagaagttgaaattgaaattgaatctggggctggtactgaatatgatataatcgttcaatctgattctttgactgaagacttagtaggacaaacgatttatacagctacaggaagatgtaatgttacttatatagaaagaagctattctaatggtaaattgcaatggaccgtaactattcataatcttttgggaagattgattgccggtcaagaagttaaagcagaaagacttcctagttttgaaggcgaaattattcgtggggttaaaggaaaggatttgcttcaaaataatatagactatattaatagaagtcgatcatattatgtaatgaaaattaaatccaacttaccttcttcccgctggaaatctgacgttattcgttttgttcatccagtaggatttggatttatagcaattacccttttaactatgtttattaatgttggtttaactcttaaacatacagagactataattaataaatacaaaaactataaatgggattctggattgcctactgaatatgctgatagagtagctaaattgactccaactggtgaaattgagcatgattcggtaacaggcgaagcaatttatgagcctggcccaatggctggtgtaaaatatcctcttcctgatgactataatgctgaaaataataattcaatatttcaaggtcaattgccgtctgaacgacgtaaattaatgagtcctttatttgatgcatctggaacaacatttgcgcaatttagagatttagttaataaacgtctaaaagacaatataggaaatccaagagaccctgaaaatccaacacaggttaaaatagatgaatgattcaagtgttatctatcgtgcgatagttacttcaaaatttagaacagaaaaaatgttgaatttttataattcaattggaagtggtccggataaaaacactatctttatcacatttggaagatcagaaccgtggtcatcaaatgaaaatgaggtgggctttgccccacctcatcctaccgattctgtattaggcgtaactgacatgtggacgcatatgatgggaacagtaaaggttcttccatcaatgcttgatgctgttattcctcgcagagattggggagatactagatatccggatccatacacatttagaattaacgatattgtagtgtgtaactcagctccttacaacgctactgaatcaggcgcgggttggttagtgtatcgttgtttagatgttcctgataccggaatgtgttcaatagcatctttaactgataaggatgaatgccttaaattaggcggaaaatggacaccttctgttaggtcaatgactcctcctgaaggccgaggagatgctgaaggaacaattgaacctggggacggatatgtttgggaatatctatttgagattccgcctgatgtatctataaatagatgtacgaatgaatatatcgtggttccttggcctgaggaattaaaagaagacccgactagatggggatatgaagataatctcacttggcagcaagatgattttggattaatttaccgtgttaaggcaaatactatccgttttaaagcatatttagattcagtttattttcctgaagctgcattgccaggaaataaaggatttagacaaatatcaataatcacgaatcctcttgaagctaaagctcatccaaatgacccaaatgttaaagctgaaaaggattattatgatccggaagatttaatgaggcattcgggcgaaatgatttatatggaaaataggccacctattattatggcaatggatcagacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcaacgtaaaatggcagtagcaaatggcaccggagcagatggtcaaattatccatgctactggatattatcaaaaacactctattgcagagtatgcaactccagtaaaagttggcactaggcatgatattgatacctctactgtaggtgttaaagttatcattgaaagaggcgaactcggcgactgcgttgaatttattaactcaaatggatcaatatcagttactaatcctttaactattcaagctattgattcaattaaaggtgtttcaggtaatttagtagtaactagcccatatagtaaagtaactttacgctgtatttcatctgataattctacgtcggtttggaattattctattgaaagtatgtttggacaaaaggaatcaccagctgaaggtacatggaatatttctacatctggatcagttgacattccattatttcatcgcactgaatacaatatggctaaattactagttacatgccaatcggtagatggaagaaaaattaaaacagcagaaataaatattcttgtggatactgttaattcagaggtcatttcttctgaatatgctgtcatgcgagttgggaatgaaaccgaagaagacgaaatcgctaatattgcatttagtattaaagaaaattacgtaacggcgactataagttcttcaactgtcggtatgagagcagcagttaaagttatcgctacgcagaaaatcggggtggctcaataatgaaacaaaatattaatatcggtaatgttgtagatgatggtaccggtgactacctgcgtaaaggtggtataaaaataaatgaaaactttgatgagctttattatgaactcggtgatggtgatgttccatattcagccggtgcctggaaaacttataatgcttcatcaggacaaacattaacagcagaatggggaaaatcgtacgctattaatacatcttctggaagagtgactataaatcttccaaagggcacagttaatgattacaacaaggtaattagagctagagacgtatttgctacgtggaacgtcaacccagttacactagtagctgcttccggcgatacgattaaagggtctgcagtaccagttgaaattaatgttcaattcagcgatttagaactagtgtattgtgccccaggacgttgggaatatgtcaaaaataaacaaattgacaaaattaccagttcagacattagtaatgtagctcgtaaagaatttttagttgaagttcaaggacaaacggactttttagatgttttccgtggaaccagttataatgtaaataacatcagagtaaaacatcgtggtaacgaattatattacggcgatgtgtttagcgaaaacagtgattttggctctccaggcgaaaatgaaggagaactggttcctcttgatggatttaatattcgattaagacagccttgtaatattggtgacactgttcaaattgaaacatttatggatggtgtatcgcagtggagaagttcatatacaagacgtcaaattagattgttagattcaaaattaacgtcaaaaacttctctagaaggaagtatttacgttactgatttatcaacaatgaaatcaattccattttctgcttttggattaattccaggagaacctattaatcctaactctcttgaggttcgttttaatgggattttgcaggaattggctggcacagttggaatgccattatttcattgtgttggtgccgattcagacgatgaagtagaatgctctgttttaggtggaacttgggaacaatctcataccgattattcagttgaaactgatgaaaacggcataccggaaattttacatttcgatagagtatttgagcatggtgacattatcaatatcacctggtttaataatgatttgggtacattattaacaaaagatgagattattgatgaaactgataatctttatgtatcgcaaggaccaggggtagatatttccggtgatgtaaatttaacagacttcgataaaattggttggccaaatgtagaagcagttcaatcttatcaacgcgaatttaatgctgtttcaaatatctttgatacgatttatcctattggaactatatatgaaaacgctgttaatccaaacaaccctgttacatatatgggattcggctcatggaaattatttgggcaaggaaaagttttagttggatggaatgaagatatttcggatccgaattttgctctaaataacaacgatttagattctggcggaaatccttcgcatactgcaggtggaacaggtggttctacttctgttacattggaaaatgctaatcttcctgcaactgaaacagatgaagaagttctaatagttgatgaaaatggatcagtcattgttggtgggtgtcaatacgatccagatgaatccggtccaatttacactaaataccgtgaagctaaagcatctactaactctactcacactccgccaacatcaataactaacattcaaccatatattacagtttatcgttggataaggattgcataatgagtttacttaataataaagcgggagttatttcccgcttagccgattttcttggttttagacctaaagctggtaatatagatgtaatgaatcgtcaatcagttgggtcagtgacaatttctcaattagcgaaaggattctatgaaccaaacgtagaatcagctattaatgatgttcataatttttctataaaagacattggtacaattattactaataaaactggtgtttctcctgagggtgtttctcaaactgattattgggcattttctggaactgtaacagacgattctcttcctccgggttctcctgtcacagtattagtatttggtcttccagtttcagcaactactggaatgacggcaattgagtttgttgcaaaagttcgtgttgcccttcaagaagctattgcgtcatttactgctatcaactcatataaagaccatccgacagatggtagtaaattagaagttacttatttagataatcaaaaacatgtattaagcacatattctacatatggaataactatttcacaggaaattatttctgagtctaaacctggctacggtacatggaatttattaggcgcacaaactgtaactttagataatcagcagactcctacagtactttatcattttgagagaacagcatgagtaataatacatatcaacacgtttctaatgaatctcgttatgtaaaatttgatccaactggtacaaattttccggaagagattactgatgttcaggctgctatagcagccatttctcctgctggcgtaaatggagttcctgatgcatcgtcaacaacaaagggaattttatttcttgccactgaacaggaagttatagatggaactaataataccaaagcagttacaccggcaacgttggcaacaagattatcatatccaaatgctaccgaagaagtttatggacttacacgttattcaacagacgatgaagctgtagctggtgttaataatgaatcatctataactccggctaaatttactacagcaattaatcacatttttgatacacgaatttcttctgaaagttcacttggcgttattaagttatcatctctaccgcaagcattagctggtgcagatgatactactgcaatgactccattaaaaacgcagcagttagctattaaattaattgcgcaaattgctccttctgaaaccacagctaccgaatcggaccaaggtgttgttcaattagcaacagtagcgcaggttcgtcagggaactttaagagaaggttatgcgatttctccttatacgtttatgaattcatctgctactgaagaatataaaggcgtaattaaattaggaacacagtcagaagttaactcgaataatgcttctgttgctgttactggtgcaactcttaatggtcgtggttctacaacgtcaatgagaggcgtagttaaattaactacaactgccggctcacagagtggaggtgatgcttcgtcagcactagcttggaatgctgacgttatccatcaaagaggcggtcaaactattaatggaacactccgcattaataacacgcttacaatagcttcaggtggagcaaatattaccggaacagttaacatgaccggtggttatattcaaggtaagcgtgtcgtaacacaaaatgaaattgatagaactattcctgtcggagctattatgatgtgggccgctgatagtcttcctagtgatgcttggcgtttttgccacggtggaactgtttcagcatcagattgtccattatatgcttctagaattggaacaagatacggcggaagttcatcaaatcctggattacctgatatgcgtggtctttttgttcgcggctctggtcgtggctctcacttaacaaatccaaatgttaatggtaatgaccagtttggtaagcctagattaggtgtaggttgtactggtggatatgttggtgaagtacagaaacaacagatgtcttatcataaacatgctggcggatttggtgagcatgatgattctggagcattcggtaatacccgtagatcaaattttgttggtacacgtaaaggacttgactgggataaccgttcatacttcaccaatgacggatatgaaattgacccggcatcacaacgaaattccaaatatacattaaatcgtcctgaattaattggaaatgaaacacgtccatggaacatttctttaaactacataattaaggtaaaagaatgacagatattgtactgaatgacttaccattcgttgacggccctcctgcggagggccagagccgcatttcctggattaaaaacggcgaagaaatattaggagctgacacacagtatggaagcgaaggttcaatgaatagacctacagtttctgtactaagaaatgttgaagttcttgataaaaacattggaatacttaaaacatctttagaaaccgcaaatagtgatattaaaaccatccagggcatcttagatgtatctggtgatattgaagctttagcgcaaataagtatcaataaaaaggatatttctgacctcaaaacgctaaccagtgaacatacagaaatattaaatggaactaatagtactgttgacaacattcttgctgatattggtccatttaactccgaggccaactctgtatacagaacaatcagaaatgatttactgtggataaagcgtgaacttggacaatacactggtcaagatattaatggtcttcctgttgtaggaaatcctagtagtggaatgaagcatcgcattattaataatactgatgtcattacttcacagggaatacgtttaagtgaattagaaacaaaatttattgaatctgatgtaggttctttgaccattgaagttggtaatcttcgcgaagagcttggaccgaaaccaccgtctttttcacagactgtttatagtcgtttaaatgaaattgacactaaacagacaacagttgagtctgatattagtgctattaagacctcaataggatatccaggaaataattcgattattacgagtgttaatacaaacactgataatattgcatctattaatttagagctaaatcaaagtggaggtattaaacagcgtttaaccgttattgaaacttctattggttcagatgatattccttcgagtattaaaggccaaatcaaagataatacaacttcaatcgaatctttaaatggaatcgtcggtgaaaacacttcatctggtttaagagcgaatgtttcgtggttaaaccaaattgttggaactgattctagcggtggacaaccttctcctcctgggtctcttttaaaccgagtttctacaattgaaacttctgtttcaggcttgaataacgatgttcaaaacctacaagtagagattggtaataacagcacaggaattaaagggcaagttgtagcgttaaatactttagtaaacggaactaatccaaacggttcaactgttgaagagcgcggattaaccaattcaataaaagctaacgaaaccaacattgcatcagttacacaagaagtgaatacagccaaaggtagtatatcttctctgcaaggtgatgttcaagctctacaagaagcaggttatattcctgaagctccaaaagatggtcaagcttacgttcgtaaagacggcgaatgggtattactttctacctttttatcaccagcataacatggggccgcaaggccccaaaggatttttaaatgtcaggatataattctcagaatccaaaggaactcaaagatgtcattctaagacgtttaggggctccaattattaatgttgagttaacacccgatcaaatctacgattgcatccagcgtgccctagaattatacggtgaataccattttgatggacttaacaaaggttttcatgtattttatgtaggagatgacgaagaaaaatataagaccggagtcttcgatttaagaggttcaaatgtattcgcagtaactcgcattttgcgcacgaatattgggtcaataacgtcgatggacggaaatgctacatatccatggtttactgactttcttttaggaatggctggtattaatggtggcatggggacttcttgtaatagattttatggaccaaatgcctttggagctgatttagggtattttacccagcttaccagttacatgggaatgatgcaagatatgctttcgcctattccagacttttggtttaattcagcaaatgaacagctcaaagtcatgggaaacttccaaaaatatgatttaattattgtagaaagctggactaaatcatatattgatactaataaaatggttggaaatacagtaggatatggaacagtcggtccacaagatagctggtcattatctgaacgatataataacccagaccacaatttagttggtcgcgttgttggtcaagatccaaatgttaagcaaggtgcttataataatcgctgggtgaaagactatgcaacagctttagctaaagaattgaatggtcaaattttagcacgccaccaaggtatgatgcttcctggcggtgttacgattgatggacaacgcttaatagaagaagctcgattagaaaaagaagcactgcgcgaagaattatacttgcttgatcctccatttggaattttggtaggttaatatggctacttatgataaaaatctttttgctaaattggaaaaccgcacaggttattctcagaccaatgaaactgaaatattaaatccttacgtaaatttcaatcattataaaaacagccaaatattagctgatgtattagtagctgaaagcattcaaatgcgaggtgtagaatgctattatgttccaagagagtatgtttcccctgatttgatattcggcgaagacttaaaaaataaatttactaaagcttggaaattcgctgcatatttaaattcatttgaaggatatgaaggagctaaatcgttctttagtaattttggtatgcaagtacaggatgaagttactttatccattaatccaaacttgtttaaacatcaagtaaatggaaaagaacccaaggaaggcgatttaatatattttcctatggataacagcttattcgaaattaactgggttgaaccatatgatccattttatcaattaggccaaaatgctattcgtaaaattacagcaggtaaattcatttattctggagaagaaattaatccagttctacagaaaaatgaaggaattaacattccagaatttagtgaattagaattaaatcctgttcgcaatcttaatggtattcatgacattaatattgatcagtatgctgaagtagatcaaattaattctgaagctaaagaatatgttgaaccttatgttgttgtcaataatagaggcaaatctttcgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacacttcatgatgaaattaaataaatggacatcaataaattcacaagaagatgtagctaaagttgaaactattctacctcgtataaatttacatttagttgattttagctataatgctccatttaaaacaaacattttaaatcagaatttactgcaaaaaggcgcaacttctgtagtatcacagtataatccatctcctattaaaatgatttatgaattgagtatctttactcgctacgaagatgatatgtttcaaatagttgaacagattcttccatattttcaacctcattttaatacaactatgtacgaacagtttggaaatgatattccatttaaaagggatattaaaattgtactgatgtctgctgctatagacgaatctatagatggagataatttatcccgtcgtagaattgaatggtcactaacatttgaagtaaatggatggatgtatcctccagtagatgatgcagaaggattaattcgtactacttatacagattttcacgccaatacaagagatttgcctgatggcgaaggtgtttttgaatctgttgatagcgaagttgttcctcgagatattgacccagaagactgggatggaacagtaaaacaaactttcactagcaatgtaaatagaccaacaccgccagaacctcctggcccaagaacatagaggttattatggaaggtcttgatataaacaaacttttagatatttctgacctccccggaattgacggggaggaaattaaagtatatgaacctctgcaattagtagaagttaaaagcaatcctcaaaaccgtactccagacttagaagatgattatggagtagttcgtcgaaatatgcattttcagcaacaaatgctaatggatgcagccaagatttttcttgagacagcaaagaatgctgattctcctcgtcacatggaagtatttgcaactcttatggggcaaatgactacgacgaacagagaaatactgaagcttcataaagatatgaaagacattacatctgagcaggttggcactaaaggtgctgttcctacaggtcaaatgaatattcagaatgcgacagtattcatgggttcaccgacagaattaatggacgaaattggtgatgcttacgaggctcaagaagctcgtgagaaggtgataaatggaacaaccgattaatgcattaaatgatttccatccgttaaatgaagctggaaaaattttaataaaacacccaagcttagcggaaagaaaagatgaagatggaattcattggataaaatctcagtgggatggaaaatggtatcctgaaaaattcagtgattaccttcgtctacacaaaatagtaaaaattccaaataattctgataagcctgaattatttcaaacttataaagataagaataataaaagatctcggtatatgggtcttcctaacttgaaacgagctaatattaaaacacagtggactcgtgaaatggttgaggaatggaaaaaatgccgagatgatattgtttattttgcagaaacatactgtgctattactcacattgactatggtgtcataaaggttcaattacgcgattatcagcgtgatatgctcaaaataatgtcatctaaacgtatgactgtttgtaatctatcgcgtcagctcggtaaaacaacggtagtagctattttccttgcacactttgtatgttttaacaaggataaagctgtaggtattcttgcacacaaaggctcaatgtctgcggaagttttagaccgtactaagcaagcaattgaactgcttcctgactttttacagcctggtatagttgaatggaataagggttcaattgaactagataatggttcttcaattggcgcttatgcttcctctcctgacgcagttcgtggtaactcgttcgcaatgatttacattgacgaatgtgcatttattccaaacttccatgattcctggcttgctattcaaccagtaatttcatctggtcgtcgttcgaaaattattattactacgactcctaatggattaaatcatttttatgatatttggactgctgccgttgaaggtaaatcagggtttgaaccatacaccgctatttggaattcagttaaagaacgtctttataacgatgaagatatttttgacgatggatggcaatggagcatacaaaccattaatggttcttcattagctcaattccgtcaagaacatactgcagcgtttgaagggacttctggtacattaatttcaggaatgaaattagctattatggattttattgaagtaacaccagatgatcatggttttcatcgatttaaaaaccctgaaccagatagaaaatatattgcaactctagactgctcagaaggtcgtgggcaagattatcacgctttacatattattgatgttaccgatgatgtgtgggaacaggttggtgttttgcactcaaacactatttctcatttaattctacctgacatcgttatgcgttatttagtagaatacaatgaatgcccagtttatattgaattaaatagtactggtgtgtcagttgcgaaatcactttacatggatttagaatacgaaggtgttatctgcgattcatatactgatttaggaatgaaacaaactaaacgcacgaaagcggtaggatgttccacactaaaagaccttattgaaaaagataagcttattattcatcaccgtgcaactattcaagagtttagaacgtttagtgaaaaaggcgtgtcttgggcggctgaagaaggttatcatgacgatttagtaatgtctttagtgatttttggatggttatcaacgcagtcaaaatttattgattatgcggataaagatgacatgcgattagcatctgaagtattttcaaaagagcttcaggatatgagcgacgactacgcgccagttatatttgtggattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaatgaagtagatttagttaatacttttggtcaaccaaccgctgaaactgctgactattttatgtctgcgatgaatttcttgcagtacggaaatgacttacgagtagttcgtgctgttgatagagataccgctaaaaactcatcgccaattgctggtaatattgaatacacaatttctaccccaggtagtaactacgcggttggagataaaatcacggtcaaatatgtttcagatgatattgaaactgaaggtaaaattaccgaagtagacgcagatggaaaaattaagaaaattaatattcctactgcaaaaattatcgctaaagcgaaagaagtcggtgaatatccaacattaggttctaactggaccgcggaaatttcttcgtcttcctctggtttagctgcagtaataactcttggaaaaattattactgattctggtattttattagctgaaattgaaaatgccgaagctgctatgacagctgttgactttcaagcaaatctcgaaaaatatggaattccaggagtagtagctctttatccaggcgagttgggcgataaaatcgaaattgaaatcgtatctaaagctgactacgcaaaaggggcttctgcattacttccaatttatccaggtggcggaacacgcgcatctactgccaaagcagtgtttggatatggaccacaaactgattcacaatacgctattatagttcgtcgcaatgatgctattgttcaaagcgttgttctttcaacgaagcgtggtgaaaaagatatttacgatagtaacatctatattgatgactttttcgcaaaaggtggttcagaatatattttcgcaactgcacaaaactggccagaaggcttctctggaattttaactctgtctggtggattatcatcaaatgctgaagtaacagcaggagatttgatggaagcttgggacttctttgctgaccgtgaatctgttgacgttcaactgtttattgcgggttcttgtgccggtgaatctctagaaacagcatctactgtccaaaaacacgtcgtttcaattggggatgctcgccaagattgcttagtattgtgctcaccaccacgtgaaactgtagttggaattcctgtaactcgtgcagtagataatttagttaactggagaactgcagcaggttcatacactgataataactttaatatcagttcaacctatgcagcaatcgatggcaactacaaatatcagtatgacaaatataatgatgtgaatcgttgggttccattagcagctgatattgctggtttatgcgcaagaactgataacgtatctcagacttggatgtctccagctggttataatcgtggtcagattcttaacgttattaaactggctattgaaactcgccaggctcagcgcgaccgtttataccaagaagctatcaacccagtaactggtacaggtggtgatggttacgtattgtatggtgataaaacagctacttctgttccttctccatttgatcgtattaacgttcgtcgtctgtttaatatgttaaaaacgaatatcggacgtagttcaaaatatcgtttgttcgaattaaacaacgcgtttactcgttcatcgttccgcacagaaacttcccagtacttacagggaattaaagctctcggtggaatttatgaatatcgtgtagtttgcgatacaacaaataacactccgtcagtaattgatagaaatgagtttgttgcaacattctacattcaaccggcgcgcagtataaattatattactttgaatttcgtcgcaactgctactggtgcagatttcgatgagttaactggtcttgcaggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacgtttcaatgtaaagccactgctttaccagctggtattgtagaaaaaattccagtcggatttatgaaccgtaaaattaacgtagcaggcgatcgtacattcgatgactggactgttacagtaatgaacgatgaggcacatgatgctcgccagaagtttgttgattggcaaagcattgctgctgggcaagggaacgaaattactggtggaaaaccagcagagtataaaaagagcgctgttgttcgccaatatgctcgtgacgctaaaactgtaacaaaagaagtcgaaattaaaggcttgtggcctaccaacgtgggtgaacttcaattagattgggattcaaacaatgaaatccaaacctttgaagtaactctcgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaacgaagctgcttctccttataatgctgcattccaaacaatttttggttcatatgaaccgggaatgaaaactactcgtgagcttattgatacatatcgtaatctcatgaataactatgaagtagataatgcagtttcagaaatcgtttcagatgctatcgtctatgaagatgatactgaagtcgttgcgttaaatttggataaatctaaatttagcccaaaaattaaaaatatgatgttagatgaatttagcgatgtattaaatcatctatcgtttcaacgaaaaggttctgatcattttagacgttggtatgtcgattcaagaattttctttcacaaaattattgatccaaaacgtccaaaagaaggcataaaggaattacgtagattagaccctcgccaagttcagtatgttcgtgaaattataacagaaactgaagctggcacaaaaatagttaaaggttacaaagagtattttatatatgatactgcacatgaatcatatgcatgtgatggtagaatgtatgaagctggcacaaaaataaaaattcctaaagctgccgtcgtttatgcccattctggattagtcgattgttgtggtaaaaatatcatcgggtatttgcatcgtgctgttaaacctgctaaccaattaaaattattagaagatgctgtagtcatttatcgtattactcgtgctcctgaccgtcgtgtttggtatgtagacacaggtaatatgcctgctcgtaaagctgccgagcacatgcaacatgtcatgaacacgatgaaaaaccgtgtagtatatgacgcatcaacaggtaaaataaaaaatcaacagcataatatgtctatgaccgaagactattggttgcagcgccgcgatggtaaagctgtgacagaagttgatactcttcctggtgctgataataccggtaatatggaagatgttcgttggtttagacaagctctttatatggcattacgtgttcctctttcacgcattccgcaagaccaacaaggcggtgtgatgtttgattctggaactagcattacacgtgatgaattaacgtttgctaaatttattcgtgagttacaacacaagtttgaagaagttttcctagatccgcttaaaacaaatcttttgcttaaaggtataattacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgttgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtaccaatgcttgaatctcatgatggaaaagacttaggtttaaaacctggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccatggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggcatcaaagccgaactgtttgaatccatgcttggtggattaaaagagctctttgttgaacacaacgttgttgttccagaagaatcagttgatgttgtagctgaaatggaagaagagctgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcatctggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttataatgctactaacattgctgcaggtcagacttctggcgcggtaactcagattggcccagctgttatgggtatggtacgtcgtgctattcctaacctgattgctttcgatatttgtggtgttcagccgatgaacagcccgactggccaggtattcgcactgcgcgcagtatacggtaaagacccaatcgcttccgatgctaaagaagcattccacccaatgtatggtccagatgcaatgttctctggtcagggtgctgctaagaaattcccagctctggctgctagcacacaaaccacagtaggtgatatctatactcacttcttccaggaaactggtactgtatatctgcaagcttctgttcaagtaacaatcgatgctggcgcgactgatgctgctaaattagatgctgaaattaagaaacaaatggaagctggtgcactggtagaaatcgctgaaggtatggctacttctatcgctgaactccaggaaggtttcaatggttctaccgataacccatggaatgaaatgggcttccgtatcgataaacaagttatcgaagctaaatctcgtcagctgaaagctgcttactctatcgaattagcacaagacctccgtgctgttcacggtatggatgctgatgctgaactgtctggtattctggctaccgaaattatgctggaaatcaaccgcgaagttgttgattggattaactactcagcgcaggttggtaaatctggtatgaccctgactccgggttctaaagctggtgtatttgacttccaggacccaatcgatattcgtggtgctcgctgggcgggtgaatcctttaaagctctgttgttccagattgacaaagaagcagttgaaattgctcgtcagaccggtcgtggtgaaggtaacttcattatcgcttcccgtaacgtagttaacgttctggcttcagttgatactggcatttcttatgctgcgcaaggtctggctaccggctttaacactgatactaccaagtcagtatttgctggtgttctgggtggtaaataccgtgtatatatcgaccagtatgctaaacaggattatttcactgtaggttataaaggtccgaacgaaatggatgctggtatttactacgctccatatgtagctctgactccgctgcgtggttccgatccgaagaacttccaaccagtaatgggattcaaaactcgttacggtatcggtatcaacccatttgcagaatccgctgctcaggctccggcttctcgcatccagagcggtatgccttctattctgaatagccttggtaaaaacgcttacttccgccgtgtatatgttaaaggtatctaatctttgacgatttaagggaccttcgggtccctttagttgtttttatggtataaataaatcatataaaccaaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttacggtatcaaataccttaacccagataacgaatttacatttaaaactggtgctacttacgctggcgaagctggatacgtagaccgagaacaaatcacagaattaacagaagagtctaaattaactctcaataaaggcgatttattcaaatataataatatcgtttataaagtattagaagatacaccatttgctgatattgaagaaagcgacttagagttagctcttcagattgcaatcgttcttttaaaggttcgtctattttctgatgcagcatcaacaagcaaatttgaaagctctgatagcgaaattgcagatgctagattccagattaataaatggcaaaccgccgttaaatctcgtaaacttaaaactggtatcacagttgaattagcacaagatttagaagcaaatggattcgatgctcctaatttcttggaagatttgcttgcaactgaaatggcagatgaaatcaataaagatattctgcagtctttgattacagtatcaaaacgttataaagttacaggaattactgatactggattcattgatttgagttatgcatctgcacctgaagctggtcgttcattataccgaatggtatgtgaaatggtttcacatatccaaaaagaatcaacttatacagcaacgttttgtgttgcttcagctcgtgccgctgcgattcttgctgcatcaggttggttaaaacataaaccagaagatgataaatatctttcacaaaatgcctatgggttcttagctaatggtttaccgctttattgcgatactaacagcccattagattatgtaatcgttggcgtagtagaaaatatcggtgaaaaagaaattgttggatcaattttctatgctccgtatacagaaggtctcgacttagatgaccctgaacatgtaggtgcatttaaagttgttgttgatccagaaagcttgcaaccgtctatcggtttattagttagatatgctttatctgcaaatccttacaccgtagcaaaagatgaaaaagaagcaagagtaattgatggtggagacatggataaaatggcgggtcgttcagatttgtctgttttattaggtgttaagctaccaaaaattatcattgatgaataaaacaaagggacctttcggtccctttttatttaacttaccaattcaatccaagctggacgaagtacatcttgtaccattttaactaattcctttttaatcaaagaaggattatctgcttgagttagagtaataccttcacgagaagtttcttccaaaatatcttgaacagttagccccatcacctttccaaaatcctttggaccaatttcgccaattttagaaataacgttatttacgcggtttagtgtaacgtaacaagctaaaattccaaccaatttgttatcagcttctgacagttcaactttagctttaataggcttatcagactttttcttttcactaaatttagagttcttgcatttgatggctacacgattgcgattaggcagccaagaaggataacaaggtttcaatacatatccttcagcagtaaatacttcgccttttgcttcagcattccaaacgcatttatttgcatcaactaatccagcatggtctactgtaaaattataatcttggacgacagaatctaaatcatttggcaatttaataagttcttcaaatttaccgcgacctaaaagtggagccattttaaatttaaatgtattacaaaatgattccatcatataatcatcgacataagttacatcaccactttcggtagtaacaataatgtcaaatacataaaaatctttatcaccataatcgacattcttctgaatgccaggtccagcgaattcgccaaagacttgataagatacaaccgctgaagtttccataatatcttgtactgctttaatagaatcagcgtaattcttcaaaataatttcatacccaaagaaatcttcagcaggaagaataggaccagtgcgtttagcacaagttactttatcacgctcaataatcaacgagaaatttgtaccatgaatcttttcacgagctacccattcgccgccagtcaatcccaagctataaagtttttcaatgaatttagaattgtaatgattttcaagactgctatactttttaaacataattaatcctcaaaatgtaatttctaaccaatcaccatcacgctgatcactattgactttaaagctaaatccttcttttctcagccaatcaccaatttcttcagtaatcaatttatcgcgagcagtacaataataactaaaatatgttttaccttgttcagctgctttattagcaagttccgaaaaatctttaataaaacactctagtttaaactgtttacttttaagtgctttttcgcgtaattgattagcaaaagattcattttcataaagatcatactgttccatttttcacctttttattaatatgtctttttctatagacaactttttctcgagtctcaaatttattcttagcagtcatagctcgagcccacaatacagccacttctttcgcctgcaagttcaattcacgagcaatttcaatgaatgactttccagactcatgaagagtaaacaccacaacctcagttctcataatcaatctcatgttatcgagttgatgccattatatacaacgttttctgattgtgtcttgcgtgctttcaaaatgaagaaaggggccgaagccccttatgattatggataggtatagatgataccagtttctaaagcagttttatgaatgatgtatccattacgtgattcttgaacatcaacttctggatagtctttcatcattttctgaagagtgtaacgatgcaagtagtacttactatctggatcatcagttttccaatctttaccttcttcggtcattttttggatttcatccataacccaccaaccgcaccagatgtaagctgaagtacgatgtggaagaggatgaacataaggcaattcaccttctggttccggagcaactttatcagttacctgaacttgaccttctgctgtgatagttttgctatcatagtcagttgctgtaacgacagcagtaacttcaatagtttgacttccaatagatgatgtatcaacggtgtatacattagttgacccttctactggagaagaatctttcttccatgaatattcaatttgcgcttcttctggagcatcagtgacattagcagtaaatgtagctgaagcatcttgttgaacgttaatagaaggaggagtcaatgtaacctgtggattcattgtcttcttattaactgttaatgatacttcattagaagtaacttcctttgcatcataatccgttgccgtcacttgggctacgcatttaattcgttttactccacttgtagtaggagtataactaaatgtggtgttagtttctccaccaatttgagaatcatctacataccattgatacgtagcagatgcgcctgatggttgagaagctaaggcagcggtaaattcaacagctgttccaatcactccagcagcaggactatcaggagttactgccaaggtagttgtctgtgtcttattttgaactgtgatagttgtagtagcttctgctgtttcagcatcagtatctgggactgggtttgttgcaactactttaatagtcttttgaccggcaggtccttttaatacataattaaaagttgcttcagctccatcttgtggaacatcatctacagtccaagcatatgtaataggtccatctccagtttgaccactgggtgtagcagtaaactgctgagtctgatctataactccagtaggtgttttaggagttatatcaactgtaaaagccataagttatccttattttaatgttacgaaagaagaattgcgtgtttcacgaattaaaactgatccgtcacggtttatgtaataaattaagctaaataaagtttggtgtgctgacgcgtgttcaaaactagttgggtgagatttccaatccggagtttcagcaatccattgataaatccaccaaggaacagtacagaatcctggattttttccaatcagctgaagattcggactaaagttttccggaagagtaaatacagacggcttttcagattcaataatctcagctacggcctgctcgaatttttcttcaacaaaaggagtatcttcaatcaaaacatcggtattttcgggaattttatccgtttcgactacttcaattttaatgtcagatttaaccggagaatcaatcagaagtgctgcttctggattgacttcttcatcgtcatattttaatccctctgcggcatcagcagcattgattaagtctttaatagataacccatcagtctctggcataggttcactagcgagcttctggagggcttcttcaacatcattaacgatattatcaaaagatttattctttttgacctttataccaaactgttcagcatattcagctaatttagctttagcttctttattatcatcaagagccttcagctctgcaatataatctttatctatcataatatttcctcagtataaatatagatatatttattactcggaaaatagtatgtaccactttgtatatgaaacaacaaatctaataaatggtaaaaagtatataggaaaacactctactgatgacttgaatgatggttaccttggttccggtaaggcaattcagcaggctataaagaaatatggtgaaaacaatttctctagaacaatactaaaagagtttaaaacttccgaagaagcgtacatgtatgaagaagaaattataactcctgaaataataaaaagcaaaaattattataatatgaaacccggtggaattggtggaattgttatgactacagaggttatagcaaagatgaaagaatcttccgctaagagatttgaaaactcaccgggcacggtattaggtacaacttgttacactaatggaactaaaaatatttttattaaacctggagaacttgttccagaaggatttgtaaaagggatggttcatcctaatagaaagtccagaaaaggatgtaaagtcaaaccgactaccacaggaactttttgggtcaataatggtgcaataaataaattaatacagccagacggtattattcccgacggatttattaaaggtcgtctcatgaaaagagattctaaaggcaaatttagtaaggcataattatggatattaaagtacattttcacgacttcagtcatgtacgcatcgattgtgaagagagcacgttccacgaattaagagatttcttttcgtttgaggcagatggatataggtttaatcctcgcttcagatatggcaactgggatggacgaatccgtcttttagattataatcgtcttcttccattcggcttagtcgggcaaattaaaaagttctgtgataactttggctataaagcctggattgacccgcaaattaacgaaaaagaagaattatcaagaaaagattttgatgaatggctttctaaattagaaatctattcaggaaataaaagaattgaaccacactggtatcaaaaagatgcagtgttcgaaggattagttaatcgtcgtagaattcttaatcttccaacatctgcaggtaaatctttaattcaagctttgcttgcgcgatattatttggaaaattatgaaggtaaaattcttatcattgttccaacaactgctctgacaactcagatggctgatgactttgttgactatcgtttattcagtcatgcaatgataaagaaaatcggcggtggagcatcaaaagatgataaatataaaaatgatgcgccagttgttgttggtacatggcaaactgtagtaaaacaaccgaaagaatggttctcacagtttggaatgatgatgaatgatgaatgccatcttgctacaggaaaaagtatttcatctatcatatcaggtttaaataactgtatgtttaaatttggtttgtccggttcattacgtgatggcaaagccaatatcatgcagtatgttggaatgtttggtgaaatatttaagccagtaacgacttctaaattaatggaagatggacaagtaactgagttaaaaattaatagtatttttcttcgctatcctgatgagttcactactaaattaaagggaaaaacttaccaagaagaaataaaaattattactgggctcagtaaaagaaataaatggatcgctaaattagctattaagcttgcgcaaaaagatgaaaacgcttttgtcatgtttaaacatgtatcacatggtaaagctattttcgatttaattaaaaatgaatacgataaagtttattacgtatcaggggaagttgataccgaaacccgcaatataatgaaaaccttagctgaaaatggtaaaggaataattatagtagctagttatggtgtattttctactggtatttcagttaaaaatctgcatcacgttgttttagcacacggtgttaaatctaaaattattgtattgcaaacaatcggtcgtgtattacgtaagcatggttccaagacaatagcaaccgtctgggacctcatagatgattgtggcgttaagccaaaatctgctaatacgaaaaagaaatatgttcatttgaactatcttttaaaacacggcattgatcgtattcagcgctacgcagatgaaaaatttaattacgtaatgaaaacagttaatttataagggctttggccctttggagaaaaagatgttactagaatttaaacaatttctttatgaagcttctattgatgaatttatgggtaaaattgcctcttgtcaaacattagaaggtttagaagaacttgaagcttattataagaaaagagtcaaagaaactgaattaaaagatactgatgacatctctgtgagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgtgtttcatttaattgttcttccgaactttctgaaactggtagttctttaatgtaattatagcaaggcccaggatgtacaggacctttgtctgtttcaacaaccaatgcagaatcgattggagttttacagacaacgcaaatcttatctgacatgattgtctcctctaaattatatatctatttatataactctcatatgcatatcaatgcccatatctttagaataaaaatattcatcaagatatccggcaaattttcctttaacataaagtacatcttcaccgcatggatggtcggccaggatacgaatatcttgacgcttgagattatactttttcattaagaattgaatttccgtttcgaattcttcttcataattaaaagcatcatcaatgctatatctcattattttccagcctcaaatgctcgcatgtcttgaatatgcttaatagcaaatccgcgtgatttaatagcatcaagagctccgctacagaaatccaataaaatcccccaatactgtaacgaggtatcaacctttaaaacatccttatcagctgatagaactgttttcatttctgatttctcgtaacgatccatactaaattcatcaccatctcctcgtcccgagtagtagtctaatttagctttaagagcaacttttttctgtgcatcaattctaagcatttcctttttaatacttgaatgcttattgagccatttactatataacatcacattattagctgcttcatactgcaatttagtcgaatctataaacacatctttcttcaattcttcttgaagatcttctaatctcatattgttctctattcaattgttattggatggacttagattcattataccacgtttatacgtgaagcattatactctattactagaagccagttgtagttttatctgctcaatatcatcagggttatcgatgactgaaaagcgtatttctactatcagagtataatcatcataaaccggtatcacattaactgctaatttatcaatacgtggctcatagtttcttactgcgctttcgatattgcgctcaactgtgtcagcagtaagaggagtcatattttcaaaaagttggtctgataaatcacatccaaattcagggtcaaacggtcttgaaccttttcttgttgtaataattcccaaaagactgtttttaattgaccttaatccaagcgatctggaaacgtctttgttccaatccattttcatttccgggtcaatgtcagaataaagcttattaatatttgacattatagtaactcaaagaactctttgaggcctcttattacgtgagcatgggtttttccacactctggacacttaattggaacagccaaataaacagtaggctttaaaagcatatcttttatagctacaatatctgactctgtgatgatagaatataaatcttccagttccttttcgtttaagtcttcaactggaatgctttccccgttagcatgaatcgtttctatacatgatactatcatgtgggctatatttttatcatcaaaaattttagggtatcggaatttaattttaatgtcacccagtatataccagaggtcttctggtgcatctatttgtgtatgtaatagatttatatgggttggtatttcagttccacaggtgcacttccaggagttttcgtgattaacttcaccgagagaatgtgcccataaatgaatcaacaatagttctgattcttggcggtttaaatcttttgcatttgtgcagtctttgattagctttttaacaattacttctacggaaccattatttttggcagtaataagttctagatattctttaagcgtgaatgcgcgacaattgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagaacatcggtcaccacaagaacaaaaagaaataattactgatttaattgatgattattttggagactatccgaagacttggcaaccatttatatttttgcaggtatttgtagggtcaataggtaaaactaaagtaccggtcacatttgtatgtccaaaatgtaaaaaagaaaagacagttccatttgaaatatatcaaaaagaattaaaggaacctgtttttgatgtagctaatgttaaaattaaattaaagtttccttctgagttttatgaaaataaagcaaagatgattactgaaaatattcattctgttcaagtagatgaaatatggtatgattggaaggaaattagtgaatcaagccaaatagaacttgttgatgccatcgagatagaaacattagaaaaaattctcgatgcaatgaatcctattaatttaactctacatatgtcatgctgtaataagtacattaaaaaatacactgatatagtagacgtgtttaagctattagttaacccagatgagatatttactttttatcaaattaatcacacactcgtaaaaagtaattatagcttaaattcaataatgaaaatgattcctgctgagcgcggattcgtattaaaactgattgagaaggataaacaataatgagtatgttgcaacgccccggatatccaaatctcagcgttaaattatttgatagctacgacgcttggagtaataatagatttgttgaattagctgctactattactacattaactatgcgggattctctttatggccgaaatgaaggaatgctacagttttatgattctaaaaacatccatacaaaaatggatggaaatgaaataattcagatttctgtagctaatgcaaacgatattaataatgttaaaacacgaatttatggatgtaagcatttttccgtgtcagtagattcaaaaggcgataacatcattgctattgaattgggaactattcattctatagaaaatcttaaatttggtagaccatttttccctgatgcaggtgaatctataaaagaaatgcttggtgtcatttatcaagatcgcacattattaactccagcaataaatgctataaatgcttatgttcctgatattccgtggactagcacatttgaaaactatttgtcatatgtaagagaagttgctctagctgtaggaagtgacaaatttgtatttgtgtggcaagacatcatgggagttaacatgatggactatgatatgatgataaatcaagaaccgtatccaatgattgtcggtgagccatctttaataggtcaattcatccaagaattaaaatatccattagcatatgatttcgtttggctgactaaatcgaatcctcataaacgcgacccaatgaaaaacgctactatctatgctcattcatttttagattcttcattgccaatgattactacaggaaagggagaaaactctattgtagtgtcaaggtcaggtgcttattctgaaatgacttataggaatggatatgaagaagctattcgtcttcaaactatggcacaatacgatggctatgctaaatgttctactgtcggtaattttaacttgactcctggcgttaaaattatttttaatgatagtaaaaaccaatttaaaacagaattttacgttgatgaagttatccacgaattatctaataataattcagtaactcatctatatatgttcactaatgcaacgaaactggaaacaatagacccagttaaggttaaaaatgaatttaaatctgatactaccactgaagaaagtagttcttccaataagcaataaagaagtttctattcctaaaatgggtcttaaacattataacattttaaaagatgttaaaggtcctgatgaaaatttaaaacttcttattgattctatttgcccgaatttatcaccagcagaagttgatttcgtttccattcatttattggaatttaatggaaagattaaatctcgtaaagaaatagatggttatacttatgacattaatgatgtttatgtatgtcaaagattagaatttcaataccaaggaaatacattttattttagacctcctggaaaatttgaacaatttttaacggtgagcgatatgttatccaaatgcttgcttaaggtcaatgatgaagttaaagaaattaattttcttgagatgccagcattcgttttaaaatgggcaaatgatatttttacaactttagcaattcctggccctaatggtccaataaccggaattggcaatattattggattatttgaatgaaaaagccacaagaaatgcaaacgatgcgtagaaaagttatttcagataataaaccaacacaggaagcggctaaatccgcttccaacactttatctggacttaacgatatatctacgaaattggatgatgctcaagctgcctctgaattaatagctcaaactgtcgaagaaaaatcgaatgaaatagttggagcaattgataacgttgaaagcgcagtgagtgatactaccgcaggttctgagttaattgccgagactgttgaaattggcaataatatcaataaagaaataggcgaatcactcggaagcaaattagataaattaacgagtttattagaacaaaaaattcagacagctggaattcaacagacaggaactagtttagccacggttgaaagcgctattcctgttaaagttgttgaggatgatacagccgaatctgtgggtcctttattaccggcccccgaagcagttaataatgatcctgatgctgattttttcccgacccctcagccagttgagccaaagcaagaatcaccagaagaaaaacagaaaaaagaagcatttaacttaaaattatctcaagctttagataaattaacaaagacagttgattttggatttaagaaatccatttcaattagtgataaaatatcaagcatgttatttaagtacaccatcagtgctgctattgaagctgctaaaatgactgcaatgatattggctgttgttgttggaatagacctgttgatggttcattttaaatactggtcagataaattttcaaaagcctgggatttatttaatactgactttactaaattctctagcgaaaccggaacatggggtcctttattacagagcatctttgattctattgataaaattaaacaactttgggaagcgggagattggggcggattgacagcagctatcgtagaaggactcggaagtgttctttttaatttaggagagcttattcaattaggtatggctaaattatctgctgcaattcttcgagtcattcctggcatgaaggatactgctgatgaagtagaaggaagagcactagaaaatttccaaaattctactggagcatctctcaataaagaagaccaggaaaaagttgcaaattatcaagataaacgaatgaatggagaccttggtccgatagcaaaaggattagataaaattgctaattggaaaactcgtgcatctaattggattcgtggggttgataataaagaagcactaactaccgacgaagaacgtgcagcagaagaagaaaaattaaagcaactttcacctgaagaaagaaaaaatgctttaatgaaggctaatgaagcacgtgccgcgatgattcgttttgaaaaatatgccgattcagctgatatgagtaaagactcaacggttaaatcagttgaagctgcctatgaagaccttaaaaaacggatggatgacccggatttaaataattcaccggcagttaaaaaagaacttgctgctagattttctaaaattgatgctacttatcaagagctcaagaaaaatcagcctaatgccaaacctgaaacttctgctaaatcaccagaagcaaaacaagtccaggtaatagaaaagaacaaagcacaacaagctcctgttcaacaagcatctccttcgatcaataatactaataatgttattaagaaaaatactgtcgttcataatatgacacctgtcacaagcacaactgctcctggtgtatttgatgcgactggagttaattaaggaataatatggcaattgttaaagaaataactactgatttaattaaaaagtccggtgagaaaatttcagctggacagagcactaaatcagaagtagtaactaaaacatacacagcccagtttccaactgggcgtgctagtggtaatgacactacaggggacttccaggtaacagatttatataagaatggattattatttactgcatacaatatgtcatctagggattctggaagtcttagatcgatgagatctaactactcttcttcatcttcgagtattttaagtacagctagaaacactattagtagtacagtatcaaaactatcaaatggattaatatcaaataataattcaggaacaataagtaaagctcctgtcgcaaacattcttttaccgagatctaaatctgatgttgatacatcatcacatagatttaatgatgttcaagaaagtcttatcagcagaggcggaggtactgctactggtgtgctaagtaatattgcttcaaccgcagtatttggggcactggaaagtataacacaaggtataatggctgataataatgagcagatttatacgacagccagaagtatgtacggtggcgctgaaaatagaactaaagtgtttacatgggatttgactccacgctcaacagaagatttaatggctattattaatatctatcaatattttaactatttttcttatggtgaaacgggtaaatctcaatatgctgctgaaataaaggggtatttagatgattggtatcgttctacattaattgaacctttatctccggaagacgcagctaaaaataaaacactatttgagaaaatgacagcaagtttaacgaacgttcttgtagtttcaaacccgacaatttggatggtgaaaaactttggtgcaacatctaagtttgatggaaaaacggaaatatttggtccatgccaaatacaaagcattagatttgataaaacgcctaatggtaactttaacggattagctattgctccaaacctccctagtacatttactctcgagattactatgagagaaattatcacgttaaaccgtgcttctttatatgcggggactttttaatgtattctttagaggaatttaataatcaagcaataaacgcagatttccaacgtaataatatgtttagctgcgtttttgcgacaactccatcaactaaaagctcttcgttgataagttcaattagcaacttttcttataataacttgggtctaaattcagactggttaggattgtctcaaggcgatattaatcagggaattaccacgctaattacagctggcacacaaaaactgataagaaaatcaggggttagtaaatatcttattggtgctatgagtcagcgtactgtccagagtttattaggctcatttacagttggtacatatttaattgacttctttaacatggcatataactcatctggattgatgatatactctgtaaaaatgccagagaatagattatcttatgaaactgactggaactataattctcctaatattcgtataaccggaagagaattagaccctttggttatttcatttagaatggattcagaagcttgtaactatcgtgcaatgcaagactgggttaactctgttcaagacccagtaactggattgcgtgctttgccacaggatgtcgaggcagatattcaggttaatcttcatgctcgtaatggattacctcatactgcggtgatgttcaccggatgcattccagtgtcagtgagcgctcctgagttatcatatgatggagataaccaaataactacatttgatgttacttttgcgtatagagtcatgcaggctgggtcggttgatagacaagctgcgcttgagtggcttgaatctgctgctataaatggcattcaaagtgttctcggaaatagtggaggtgttactggattatctaattcgctttcacgacttagtagattaggaggaactgctggaagcatttcaaacattaatactatgacgggaattgtcaactcgcaaagtaaaatattaggagcaatataacaatggggaccgaaaggtccccatatttttatttacggaatgaaataaaagcagcaactgaagcaactaaactgtcttcaatataaacttcaatttttaccggagcttctgactcaaatttacctgttactacaccttggaaaatgctttcagtctgttctggctttgaaaaattttcagaaggaaaaattccgaactttttatctgttccaaaaattttgataaattcatcgtaaactgcttcattaaaagcattatcagcaggaataacgccttcaactacaagttcttgacctaaaaagcgcaaagaagatttcattttgtgttcctcatgttatgtcagtaaaactactataacacaacacgagggacttgtaaactacattttgaactttttagacattccgttaatgttaaccaaagaagctaagatttgagaaacttcgttttcctcttcttttgattcttcgacaaggaattgattaaatccagtcattggacgaacttcaccagtttccatcaaatggtcgccatcatatactgattcctctaattgttcagaaggaggaacgattgtaccttcgattagatacttgttataagcagtttctttcataaagtacgtacttactttattaatcttcagtaaaattccacgtggtagaataacttcagcttctgatggaaatcctgataaatgacctggaacgataactttgattcgctcagctcctttaattaccatacccacgctagtttcggcatcttcactagcatatgtagaatgactacccatatgcatcaaatcttctgcatcaacggaaccttctccttcaccagaaaatactgcgccggaatcatctaaggccatatagtttttaccatgctcaccgaagatatttggtttaagcgatgtggatacgaagttcttgaaatagaacattttgttttcaatgttatgacgcaaagttttaaatgtaacttcttgtccacggtaaagtgtagttcctggaggaagaactgaacctttagcgaatgcagaatcaagcgtctcaatatgtttaatagctcgttccatatattcttcgcgggtagaatctggtttacccaaaaggaacgagttcatttcaacatatgaatctgcacaataatcttcaattacatcagattcagcttgagttaatccttttggagttacttcggtgctcgcgtattcatatgcctgagcggcagattcattaatcaatttataaatgccattcatgacaaattgaataatagctgtcttttcatctggtgtagctttagaacctttaactaaatcattgataattttcttaataacatcaaagctattagaaatattaatgtcagcaagatcgcttaaaattttatcagttttataatcaaagaattctttattctttaaatattcttgagaaccttgatatgttatatcgctctgcaacttgatagatggatcacgtaaacgcgcatgggctaatgcaatatgatttcggaaactttctagttcataatcattagatttaaaacgagaagcacttctcataccaccgatagctcctttgttaaagtttgaaccaatctggataaccccggagttcattggtccttctgctttatataccggaactttagattcaaactcttgatatttcttagcagcgaagctatcaccctgaagtgaagcatcaacagtagaatattgagcttgtgctgctaatcgacgactaattttagttttctgaataacagcttgatccgtacgcttatcattttctaaagcaatagaagcagcaactgcgacagctttaggaacagcattacctgttttaacgtctacataaacatcaccaacctttgattcaacttttgtgaataactcagttgaaataggaggtacacctggaatgtcttctaaattggcatttttacggtaaaccataatatatgcgtactttttatcatagtcccagatttcctttaaaagaacatatcggcctgctcctttagtacgtactaaacggtcagcaataacttgcatttgacgagcagcgccatttgttttactctttagtacgcggaataagcatgcatcaattttatactgtttcattgtttgaagagcagtatcaaaaacagcattaatgacgccaattggatttccacccaagtttttaagcttaactaatgatagtttctcattaacacctatcattacgatatgcatcattttgtcgcctggcttaacgtttttattcgtatcaccgccagaggtgtatgtacaaaatctaaatccaggaagcacgctttcttcaccggcttgaatagcaaaaatttgtggtattttatgcttaggatttaagttaacaaccggcgccgaagcgccgtcaaataattctgtaataagttccatgatttatccttgaacgaacttgtaaggcatgtttgtaatatctatgcaagacgcaataattccaagagatgattctactttctgtttaacgtttgatgaaacaaatgatgcaaagtcaactctgtcttctatttcaatatcaccagtcattgcaactacttcgccggtttccattaaacggtctccgtcatagattaccgattcggtgagttcttctgtggtcataacttcagcttgaatgagttttgtattattagatgttgttccgtcattattagaagcatcagttattttattaactttgaccatcaatccgcgcggtagaataacttcagcttctgttgctattccgagacttcctggatatacaacattaactttatgtgcgccgtcaattgcccatcctatttgaactttaacgtattcaggattttctttatacgctcttatttcgtttggattaatagttattccttcttcatttttatcaactgttaattcattacgagcttctggttctaaaagaccaataccagcatgtgtaattccaaaacgtccaaaaatgataggagttaaagaagtagatacaaaatttctgaaatagaatactttatttttaactagtgcttcgtatataggagcagtcatactttgagcacgataaactgtgatgccttccggtatgcggtcaccattttcaaaagctgaatctaagttatttatagcagattcaatttctttttcactcattacatcatatcgttctggattataacgacctaaaagaagattattgatgtcagtatatcctgaaccgcaatattctctaatgccacgcttttgtgatggagtatatttagaaccatcgcgggcaatagtaatatcaatcattggaccagcaccaattccagaaaaactgtaaatcattcgtttgaggaatttagtttttgctgcgttccaggaatttttagttatttcttcccagacttcatctggttgtcctttacgatttttattatgattagcaagccatttatctttataatcttcaaagaattgatttacagctgctgcgtatttctctaaacattttattgaagtagttggttcatttttaattgcattaaaaattacttctttaattttttctgaaacttcaccgacttgactcattggaaagaatttataatcatagtgaagttcatctgccgttccttcggcaataatttttgctgccttagttttagaagctaatgaattaattccaagcttcatttcttctgcttcgggaattaaaggagccgtagcaggtttattgaaattagctgcggtagattcatacttttggaataattcactttcaaatctagaagattctaatgattgactttgtgcaattgctctacgggaaattttaactttaacgattacagcttggtcagaacgtttatcgttttcttgcgcaatagatgcagcaattgcctcatttttagttacttgagctccagtatctttattgatataaacatcaccgacctttgattcaactttagtaaagagctcggtactaatttccggaactcctggaatgtcttctagtgatacatttttgcgatgtataagaatatatgcatactttttatcgtaatcccagagttccttaagaaggacgtatctaccacctgaacgactacggataagtctatcagcaataacttgaatttgtcgagcttgaccagcggttttagacttaagaatacggagcatacaggcatcaattttatactgacgcatagtttgcattgcaacagtaaaaactgaattgatataattaattgggcttggaccaagaccttttaatttagcaattgaacctttagcagttaatgtaaaaggaacaatatgcatcattttatcgcccatctttaaatcgcgattagtatcacctccagatgtataggtgcataaacgaaagcctggctgttcaattgcatcatcaacgtgaactgaaaaaatttgcggtattttcttctttggatttaagtttgtaatcggaagagtagtatcttcgtcaaataattctgtaataagttccatcatagcctctctagtgtttattctatttataaaattaaaggcccgaaggcctttagtaatctagtggtaagagagtacgatatatttcaaactttggtcctttttcataggcatcaaatgtttctgtaaatttattataagcgtatgcatctacaaattcgagaatgacttgtgatacagaagtagaaacatctccaccttctttttgagcaatgacaattgtttctaagtaagctttcatagaccagttacctcatgaaaatcaccaaatacatcctcgaatgtattagctttagttttatcttcacgtaaacgaatcgcaatcggaagaaataatttaacgtaatcagtgcggccatcagattttaaccaaccgttgcattcgcactctagaatttttccaatataataattttggttttccataatgcgagtacggtcaagctcatgtgattttacgccggctttatcttttaagcctgaaccagcatttactttaatttttccacattctgattcaagaataaatccacccgctttagtagggtctttacggtgaggataaattcctacaatttttaaatcaacatcaattacttctttaaatttatagagattttttgaacgagcattttcccataacccatcaacgtttttgagaataataccttcaagaccttgatcaatatactttttgtaaattaccttagcttcatctaggttatttactacctggttttcaattaaaattactttatcatagcctgatgtcatttgttctagtttagaaaaacgtacatcatactttaaacgaaatgcaggaagaccatatatttctactaatggaacataatcccagacctgaaacttcatgcattgtgcttctttttcggaaatggttccctttaaagatttattagcgattccattagaagtagtacgtgattcagctacttcagcgaattctttagctttactaatttcaggataagcatcaaaaagaaaatctaggccttctggttccttttcaacttgctcatggtataccaattcgccatcaattaacacaccttctggatgaatctggcgagcttctgcagtcattttgattaactcttccttgagaagatctaatcctagatattcattaccagctcgtgataaaagacgaacatcatctaattcatcacctctgacttcagcaaagcaccgagctccatcagcttttaattgggcaaaggctggaaatttgatattcttattaatgcctttttcatcataagaacttgccagcatttgaggttgttcaggaattaaacctggccaaactttgtttgcaatagatactgatgcaccacattcaaggtctcgcatcatcacccgacgcaaaacttcaacatcatcttttttaccgtcagcaatatatccagttaattcctcaattgccgcatttccggtcaatttccgagtagctaacgtgaattcaatgaagtcaagcatatcggtaagagtcaacattccaaaactctgggtagcaatacccggtttaggccatttcttgatataatactgtaacccacgagaataagtcagacgatatactcgtttaagcaattcgttatctttgttcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacgtaaatgaaaccttgctctacacattttttaaaaattcgttcgtctttttgagctcggaattctggattgcatctaaaaaattgatttacgtgaccataatcacgtgtagtattaccttcattttcataaatagtatgaacaacaaacattaaaatgctccttgaaaaatattatcaccactagtaggtctattatacaaatactctatgccaccaggtttaatatagttccatgtctgaaacggatgtgtctgatatggatgatatgaattataaggattaaatccaggagttctccaggtagtgttccaaggaaaagaatcgtttttgatcatcttctcaattacatcttttataactttttcactatcaaaactttctttattttccttcgatggaaaaagcttattctcgacatcattccatgtataaactcgctgtgcagtttttggaatactgtcacgctcccctcgagccatccaataaacaggaacatttaatatttcactcgcgtgatcgcaatggtgagcgagatcgtcaatataacaaattacgttatatttctcttttgcctttttgaacaactcttcttttgaagaatcatgaccacacatcaatacttctgagaaggcaccaggaaaaagagcattcaaattaaattgacgattcagcagagcgtcaatagaatcacccaatgctgtaacagctacaaaattataatcttcttttaatttgttaattacacacagggcatctttatatggagacaagtaacgaataaaatctgaacgattgtatttttcaattaacttgacgccaagttcttcatcacaattaaaaagtttacctggagaaataaatttctcatcttggatcatttttaaaatatgttccaacggaagattatatttctgggcaaaataaggaagtcctgattgccagcttaaacatactccatcaatatcagttaaaatagtaggcttcatagagagtctcttaataggtttaacacatcaataaattcagcttcggttagtattgtatcatcttttgttagaccactagccatgctgtgcttcaaaacttttcctttcgaggctagtaatgcatcacgaaagcccttgttttgaatcgctgcttcaaaatatgcatttgtgtataattctttccacgccggggagtatcttgaaaacggaactccgagccagaagagggtcccacggtcctgagctcttgcataagaccttccagcttgctgtgcggcaagcccggataacccaaatatacgacgttgttgttcaacatttttcaccttacacccttggaggaatccttcgagacctccaaattgaataccatccatgacgaaaggccattgggcgaaattacttaatgcacatgatggccacctaaaattgcttctaatctctaactcagacattttcaatgcttataatttcaacatcagcccaatgaccatagcaaggaagacgaaattcaactggccagttagggtccttttctaatataatagacttaacttgtggttcttcatgttcatcagtatatggatttttatctgttactttatatgtgaccttaatgtactgaattccaaaaatcttattaattatattcatactaattcctttaatccgtaaataggagataattcatcacccatgcgaaggtcttcatttccatctacccaggaaacaatataagcctcttttatttgaataccactccatttaaatggaggtagaaccttagaaattaatccaggtataccaactccctttaattcaacagtttgacctaaaaagaatttcattagaacctcatctgaaaaccgtgcgatttaacattaccgccaccaatatcagagatattaatttcgcgcgcaattgaagggtcaatgtcaatttcacgattgagtttagtgatagctaaagtatcgcgcccatttacagtacgaaactctaaaggacaaaccacatcaacgtagtttttaatcgattcgctagtaggttgcaaatgtgcaggaaggtctttaggcgcctttgagaaaactacttcgcagaagtttttacgggtatcaaaataagtagtcataaacataacattttcctcagtaaggggccgaagcccctcatttattttaaatatcaaattcgttaagaactacatcaaagattgcttcaagatgctcaggtttagctctgttactcagaatatgacgaatccaagttttaaccaaaagcttgcgattagcaccattccagcaaggatgagtccctaaatcacgttgacgaaaatcatcatccagagcgattttgaagtttgaaccttccattgtgattgaaaccgtgattccattttcaaatcgcatataaacgtaattaggagtcatatactgttcaatttcgcatactgatccattttgatgtttccaaaggcaaatagtatcaatagaacctgcaataccattagaaacatatttacgttcaaagttgatgtagttcattttattctccaagatgtttaattgcggtacaggtatataatatcatatcctgtaccaaagtaaacaattattttactactttccaatgctgcatgtcaagtttaccaacttttttcatcttctcaattaagcgttcggcacgttggcgagctgtaacataataccattcacctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagttttaactgtagcgttcagattaatcgttttcattttattctcctttgtttgtgtaagataatactatcacaaaggaaccatactgtaaacaactttatgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcgacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggtttttggatatttaacgaccaggataaccataaacccgtcatcattcacattcaagaggtacaccgtaaaactgccggggtcttaaaactataatgattcgcaaatcattaatcagacagttcgacggctcctcgatttagctcacactaaggcagtgaatctccaataaattacttcagtgttaccacaaagtgacgaactgcttttcgtgcagcagaagccagaggcttagcatatttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaagtaacgaatttttgtttaatttcttttggctgcttaagacccagagctacaaaaggatgcggaacatttcgaatttgaccaactggaagagaagtcaaatcaccaacttcgcaaaaacctttaggaacatcaggaccgacagagtgaactacacacagttcaggaacttcaccttgaacacgtttaccgatgataagtcctgattctgtaacttcttcatcaccggcttgtgcaggttcagaaactaaaataacatattcaccgacagcacgaattggtagctgttgtacttcagacatcgtttttcctttttgttaacagatgaattaataataacaaataattcttaaagcatttatttaccaataaattgaagcaaatgctcaactttcatgccattaacggaaatcaatttgtcaatagaaaaacctcgccatgcaccgagttcaacatcaaatatcggaatcatatcagtagattctttccgagtagattcagtcaatttaccagtttgcatggttggcataaagtcagcatcacgggtgcctttcatagtacgaatagtaccatcagacttttcaaaaactacatttgaaatacccatggacaatttagttttcaaaatttcacgaattgctactttctgctcagttgtcagtttcatttatttacctatcacagttttaatatgagttgttccacgttctttaagggtggaaagtaatttttggcatttttctaaatcagatttccaactatatggtctatcaatactagtccaatcagttttataatactgtttccatttagagaaaaaatacttcttatactctacagcaaatgaaatgttctcgttagaataagaactaattgctgtgagctgtaccaaacgaaatttcattattcaccacagaattcgttgatattttcccagtttaacttattcaagtttttcttaggaacattaaacacttcaatacccgcatttcgcagaatatcatcccagccaggtttatttttatcatatgtttcacaataaaccagctttttaataccagattgagctatcgcttttgcacaatctgggcaaggagaaagtgttacatacatagtagcaccttcaatagaagaaccatttcgtgcagcaaacaaaattgcatttagttcagcatgaatttcatttttagacgaccattccgagtgagcgctacggtgttctttcgccaagacaaagcgatcagttgaaccaaatgatacgcattcaggcttatggccttgaatgatagtatgtttaggcttattcagcaaccaaccttgctcagcagcataatcacaacagttcacaccaccagcaggtgaaccattatatccggtagaaataatacgtccattcttttcaattactgctcctaccttccaggagcaacattttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcaccagccatctttttgtgaagctcaactggatacttcgtcacaataatagcatcatacacagaaggatgaatactattcactagagtgtcattcattaaagttattctaatgaactgtgctgtgtcagagtcaagcgctctatgatcgccagtatcattttcaagacaattatcaattatatcagttaaattcatcatagtacgccatacaccctttgtgcttcaactaatccatcaaaatccaatttgagatgtgttatttggtcaccatcacctggattcacaattactaatactgaacgaggagtttcggtaataacacgaaccgatgtttctggaaatcgttcagaaaccttatttaccaattcctgagcaaatagtttaactttttcttggaattctttaacagtaatcggtttttcacttagcatgttgatcccagctccttactttcaacgtttttaactaatttgacagaaactaattcagcatcttgagtaatcattaccgggccttcttcatactcttcaagatattctagagctttctttttagcttcttccttcgtatcagtttgagcatagatatagaacatacaaccagtaatacctactactttccacttaatttctttatcagttttaatttcaaatttactgatagagtcatctttttgaacttcttcgaaaaaataatattctaacatataagtaattgaaaataacgggctatctttataagattcgcccattacatcaacagctttataccagcagtcatcaatttcacgtttaatgctaataacatttttcgcagaatctatttttactttaaatgaattttccccaataaacttggcaattcgtttattagccccgcaggtttcattaaaaatatctttatatccagctttaaagcgataaaccttatcttcttcaaaccatttgctcatttcaatttcctcatttgttttggtagagctataatatcacaactctaccgtaaagtaaactgttaaattgccttgaattctgatgtctgtgattcaaaacgaatatcgcctttgatgactagctcagcatcaagaccgaatacgacaatgatatgtgcggaacctggatacagcgtaatggcaatagaatcaacctggtctggaagcaaagtattcaatacatgagtcacttgagcatgaattcgaagctcggctgcgttatcaagcttttcaaacatattattagcgataatttggctaaacactacttctacgattttagaataagtcggaaacatatttacctcacataattttcttcaagccaatcaataacatccaacgcattatcaaaagttgaaccatctactttatcttctgtttcataatcaagaacatctaagcctactcttccatcaacaataggccataaacaaaatagatatttcttttctttttcaattttatcacaaagacgataaatcttttctatattattcataagttttccatggtaaaggcagtttagttttctttactgttagttcaatatcaggattcttttctcttaatttaaggcattcctcccaagctctgatttcactagtgaatacacaaaattgcccattactagtaccaactaaaccactatttacaataacaatagaccaagtttcatgatgccacgccattaaaaatctcccgaagcaacttgccagcattcaacaccgatacgacgccacatttcaactacttgagttcggtcatcaatagctaatttcacatcaaaatgcggtgcgatgtgtttccagaaaatttcttctttgactacatcatctttacgggtatcaccttgttcgcgttgacattgcataactaatggaacgccagcaatatcctcaacccattcacgggtcatacgataatatttcgttgggtcttcttcggttccactttcacggcctgaaacgactacgatgtaatatccttgcttatcgtacatcttagctagttcaacaatcataggattgataacatcagtatcacatttttcaaggtcataaggaccacgaccattcattttggctagtgtgccatcaacatcaaaaataactgcttttggtttaccaggagtccctttgtataccggaagaccgagatactctcgcatgcttttatacattgagcgtaaaacatcaattggtactgctttagttccacgctttgagttacgtttaaccaattcagtccaaggaacatcaaacactttatattcaactttccagccgtattctttggcaaaagtttcccatgccaggcgccgttcgggattcaggttagtatctgaaatgattactcccttgacagaatcaccgccatacagaatatttttagctgtatcaaactgcataccagatacgatgccttctttctttttggtatacttatactcatcgcgttcttcatgtgccataatagattggcgatagtcatcacgattgatattataaaatccaggatttttagcaataaattcacgagcccaagtactcttacctgaaccaggacatccaacagtcaaaataatctttttcatcatttaattcctaagaaaacttcaagaatacgaatattatgctcacgccgccctttatataattcagctgttgattgattcaccgatttgctctgaacattagatgaaataaattttatcatgtgatttttaagctgatacatatcaagcccacgggcttttgcttcttttcgtagggctttaccagcatcatctaaagctttcgcagggtcttcatcatttaatactaccccacggtccaaatccatatatactgcaccattacatgcatcaatgtaacggtctgaacattcaatataacgttctaacagagttttcatttattatttctcaaccaatgattgaatataatcatgcaagtctttagatgctttaccccacttattttggtattcatttttaagattagcacgtgattgagctaataaaacatcattagttggaggtaaagattctaaccgctgaatctggcgtccataaatcattgcagccatctcggattcataaatcaatcctttgagatgttcaaattgatgccacgaaatcatttacatttatcctcttttaactcttgacgataataacatatcatagttttctggtcatgtacatatcgttttacatcattaagccaaatacgaaattcctgagaatcttcaaatggcataccgacccaagctttaccgtcaataactttaacctgccaagatagtttagcttcatcatatgactttatttgcacaggccaattaggatgaactgtttctttctttacttctagaggctttgtcgaacaaccaactagaagaccaatagataatattactgctgatagtttaatcatttagaaaggtcctggatgtcttctgtgaacttgttgaaggagttgttgatttgtttttcaaccaatcctggcttatgagccaccacatccgccttctttgcgtctttgcgcagtttttcattttcacgctcaatagcagcaattgcctcacgatttttattattcatcgcatcaatataattatactgaattcgcaaattatttaatgctaaagcgttttcattggccgtttttgtaatttctacaacagacgtttctaatctttcaattttattttttaaaattaaagaagttccgcctaatgcaattacaattaatagcaagcctgctgtcgtattacttaattgcataaagttttaataacctctataatatcgtcttgagaaagaccgttaattaaaatatgatgttcagccggagatttagaaattttaaagcatgcctcaacatcttctgccatatccgatgcgctacgatttggattactaattccaagacgatgttttcccgttaaaggattaacgatgatatagcatttacagttgttaatatgaacattaggttgagtctgattaatgaacacatcacaatcatatttcgcaagctgattttctaaaaagactttcatctcctcaaccgcatcaggaagcatatcacgggcttgctcaagacgacgatttcgatattctttaatggtcgttttccgcttgacttgcttagctaaatctttcttaagatcggtgatatatccaactcgacgatttcctttaaatacagaaatcccatctgtagtatcaccgtatgcttcaacgaccatctcagtagtaataagctgcaaatccatcataaagtcctcatgttatgtcagtaagattactataacacaacacgagggacttgtaaacagcttagtatccttctgggataaattttttataatttttcaaaaaattctgttcgatttcacacatgaccttttcttgactatcgtacccttggtagaggctcatgatgataccgaacagatgttccattccagcacctttagcaacgccttgcgcttccatcgcataagtctttctatctttgccgcaatgcttattgtgacagtcaagaactaaaaacagagctcggtctaagtacttcagataagtcgtttcaaatgcttcaatttttctatatgagtattcatcatcggcgtacattgctttaagatcatctgatgcaccatcaataatagtcttaaacaatttttctggattatctaatgaactttttgtactatgaagagacacgtaccaatcagacttaattttaaaatgagaaccatctttcatcacggcaacatagccttcgatgttttctgcatttttagcttcttctacccatttagggctatcgatttcgtatcgttcaaccagatacggacgaagaacagcatctttataaatatcatcatatgaaatgtattcgcctgtttcattttcacgaatattcaataaaatgattttcatctcttgataagcaagaacaattctattagttggagcgacaaattcaaagttagcagtaaatccatcttcggctaattttttaagtctgtcgcgcaactggtgatgattaatattcatcaaaattccattagccattaaagcctgctcagatttgattgaaccctttgatttgaacagaatttcatcaccgtctaaataagttgataccaaagacccatcttcttttgttagaatgtaatcaacatcatttaaatcgatattcatcgtgaatggattttcatttaagttaaaaaacttttccataggacgagaagcaattcttactggtttttctccatccatttcaaacatgattccacgacattccaatgcgtctggaagtaaccaatcagaataagatgcataattatatgagaaaattctgtaagttcttccagatgcacttacatcatccgagtaaaaaaacttacgctgtgaatccttacatagttccattaaattgttaaaaagttcttgcattgtgtatcctcttttgtgttttgaatatagtaccacactccatgtggaagcatcattttttcttgtgttgaatattccaaggcgggttaaacagtttaatgaatagtggctcctctaggtcaatcgttgcgattgtcattgtacctaactcatttgtcatagaaagattaaaacattggcgggcgtaaaattcaactttgcttccttcctttagcgcagcatgaattaatgcagatttagtagaatcagacgttttgtctttacggttaatagcagttctataatagtttattcttttacgtaaatttttagtttttccaatataaacaagctcatcatttatagcaatagcataaattacgttatacttgtttggaatagataattgttttatacttccgttgtcgtctaattctaactcagtatatttaataaatgaatattctgttgcaatttctttcataataaaatgggccttgcggcccactccttaaaaatattttttaaaactcatcataactttatcatcaacatcattatcaatctgtgcaacaaggtaagatgacagttctacttcttgcggtgcagattgaacattatcagaattaagatattcacgaatccaaggatatggatgcttaatcggagcatcggtaattgggcatggaagaccgcactgtttcatacgagatacagttaagtaatcaataaagctccacatgctatttgtatttaatccaggaacatcaccatctttaaataaatgaactgcccagtctttttcctggcggttaacttccatgaaaatatcaactgcttcttgttcacactctttggcaattttaacccattcatcaccatcagtgccaagttgaagttgacgaataatatattgtgtacctttaagatgaagctgctcatcacgtgcaatgaacttcataatcttggcattaccttccatgatttccatattcttgtggaagttaaaggtacatgcaaaagatacataaaaacgaatagcttccaatgcgttgattacgtgcaggcagaggtaaagagagcgcattagttcacgtttccaatacatttcatgctctatggcatcttcaataacgtcttcgtctgcattaatttctttttggtattcgatatcagctttagcgttttcccaataacgagttttaatcagaacatcatcataataacgtccaatggattcagcacgtttcataatagcttcatctaatacaatttcatcaaatactttcgatggatcagtataaagatttcgcatgatatgtgtatatgaacggctgtgaatagtttcactaaaagtccacgtagcaacccatgtatcaaggcttgggtctgaaattaatgacataagtacagcagacggcgcacgaccctgaatgctatccaaaagtgattgatacttcaggttattagtaaaaatattttgctgatactgaggaagcttattaaattgcgcagcatccatcattaagtttacttcttcaggacgccagaaaaatgacaactgcttttcggttaaatcttcaaaaactttatgacgttgaatatcataacgcgcaataccaagacctgaaccaaaaaacataggttcttttaaaacatcaactggatttgtattaaaaactgtgctcataaattttccacttagttaatagatagtgactcgtccatgagtcaaattatatcataatttacaggatgaacaatcttcagcttttggagtttctatttcataatcatcagtaccagaaccatcacgggtattatgataatagaaattttttccgccaaaataccaaaaatacaaaaggtcatcaatcattattgacattggaacctttccttttggaaaaatctgtgggtcataatatgtattcgccgaagctgattgacaaacccatttcagcataatagctacctgcgtaagataaggtttattacctttcttagctaatttccatgtataatcatagaggtctatgttatgctcaatattgggcacgacttgattaaaggagccctcttttgattctttaacagagactggtccacgtggaggctcgataccgtttgtactgttagaaacttgggaagatgactcacatggcataagtgctgataatgtgctattacggatgccaaagagcttaaggtcttcccgcagcgacgaccagtcacaaacgtattttggagctgcgatttggtcaatctttttattgtaccagtcgataggtaattcgcctcgagaccaacgagtgtctgaataatattcgcaaggtcctttttctttggcgagcttaatggatgctttaatgagtccatactgtaatctctcaaatagttcatgtgttaaatcgttagcatcttcataagaagcaaagttacttgccagccaagctgcatagttagtaacacctacaccgaggttacgacgctttttagctttttctgcttcaggaactggatatccttggtaatccaaaagattatcaagagcacgaacttgaacttctgctaattcattaattttatcttggtcttgccaatcgaagttatccagcacaaatgcagataacgtgcacaatccaatttcagcatcaggactattcacatcatttgttggaatagcaatttcacagcacaagttactctgacgaataggtgccttttcacgaataaacggagtatagttattcgtattatcaatgaactgtacataaatccttgctgttcctgagcgttcagtcatgagcaattcaaatagttcacgggctttaatacgctttttacgaatattagggtctttttctgctgcttcgtataattcacggaaacggtcttggtctttaaaataagaataataaagctcgccacccatttcatgcggactgaacaaagtaatgtaatcgttctttccgaatcgttccatcatcaaatcattcagctgaacaccataatccatatgacgaatgcggttttcttctacgcctttgttatttttcaaaacgagaagattttcaacttccaaatgccaaataggataataagcagtagcagcgccgccacgaattccaccctgtgaacatgatttaactgcagtctgaaaatgtttccaaaaaggaataacaccggtatggcgtacttcacccatgccaatcttagaaccttcggcacgaatcataccaacgttaataccaattccagcacgtttggagatatattcaacaattgaagcggaagccttgttgatagactttaatgaatcacctgcctcaataacaacgcatgaactaaactgccgagttggagtacggcaaccagccataataggagttggcaatgaaatctgtcgagtagatactgcttcataaaaacgaataacatgttttaatctatcaacaggttcatcttgatgtaatgccattccaatagtcataaatgcaaactgtggagtttcataaatttgaccagtagttttatctttaactaaatatttttcttttaattgcatcgccccggaataagtaaattccatatcccgctcatgcttaatttttgattctaaaaatgtaatttcttcggcagaatattttgacaacaattcagggtcgtatttaccttcatttacacagtaagaaatatggtcaataaatgagcatggttcatactgaccataaacatgcttacgaagagcgaacattaaacagcgtgcagctacgtattgataatcaggctcttcaaccgaaatagaattcgcagcagccttaattacaatggtttgaatgtcatcagtggtcattccatcacggagatatgatttaatattttcatataattcataaggatctacagatgttccttcagctgcccaagataaaactttaataattttttgcgggtcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccggcatagacggcccacgctggaataattcatcatattgtttttccgttaatacagtaatatcatagtaacaatcggaagaagttttaactgtggaaattttattatcaaaatactcacgagtcattttatgagtatagtattttttaccataaatggtaataggctgttctggtcctggaacttctaactcgcttgggttaggaagtgtaaaaagaacaacgccagaagtatctttaaatcgtaaaatcatacatcctcgcaataataaaattacaccgccatttttcctttaattggcagatgagatacatagttgttaagaacaaaattatgaggctttgcaaattgactcaaccaaaatacctgcgattctgtgtcccattcatcaaattcatctggaaattttaattgtaattcgcataaatccataggttcacgacgtaaaatttctttacattgttctacgtgattcatatagatatgagtattaccaccagaaaatatcaaatctccaggaataagattacacattttagctacaatatgaactaacgtagcatatgatgcaatattaaatggaagaccgaggaaaacatctaccgaacgttgataccactgcaaatctaaatagccattacgcacattaaactgatagaacatatgacaaggcggtaatgccatatatttaagttcagctggattccacgcagaaacaatttgacgcctatcatttggcagttttttaatacgatcaacaacttctataatttggtctacaccgccaaaatcacgccactgttttccataaattggaccaagttcaccgctatgatatcctaaatcttttgcctgattttcgtaattttcatcccagactgttttaccttggattaacgaatcgtgttgaattaatcgtaaatcattgacatttgtgcttcctgataaaaaccatattagctcagcaatgcatgcattccaggcgagctttttagttgttactgcaggaaagcctttagttaaatcccaacacaatttagtaccgaacagagcaattgttcctgtgcctgtgcgatcatcggtttcatagccattttcaaaaatgtctttaattaaatcttggtattgtttcatttagtaccttatataaattataatacattttatgaagctaaataatcaatacggtttagcatcaaattttctctcaatttcaggtgtgaaatataattctttaccgcgtttggaaaagcgaccaataatatgataattattctcatcaaacgtgatattaccaatatccatagctttcaaccaaatatcgatatttctatccagctttatatcaaaattccaatacggagaactattaccgaaaataatgcaagcggattcagtgaaacaactgctataaatcttgtctttaggaactactaattgatagacacctttaataactgaggaccctgccactttggctgtttctcgtctttttctaacagaatagggtaataattaaaattcatatttccgccacgcgttatttcatttatatactgattccgtaagggttgttacttcatctattttataccaatgagtttcaaccatttcacgcttgcttatatcatcaagaaaacttgcgtctaattgaaccgttgaattaacacgatgccttttaacgatgcgagaaacaactacttcatctgcataaggtaatgcagcatataacagagcaggcccgccaattacactaacattagaattctggtcaagcatagtctcgaatggcgcgccagaaattgatacttgaatttcgtcgccagaaatgtaatctatatattgctcccaagtaatatagaaatgtgctaaatcgccgtctttagttacaggataatcgcgctcaaggtcacacactacaatatgtctacgaccaggaagtaatgtagataatgactggaacgttttagcacccataatcataattgtaccttcggtacgagctttaaaattctggaggtcctttttaactcgtccccatggtaacccatcacctaaaccgaatgctaattcattaaagccttcgaccgttttagttggagaataagcgaataccaatttaatcattacgcaaaacccctttcaagaaaccattcagtggctttattagcatcaaagaacatttcttcataggtcttttctttgttttcaaagactgtcacacaaacacgttgacttgctccacagtattcttctgacatactcaaagcatcagaaaacatttcattaaattcatttaaatcaggattatacaatgcattaaaaattgcataatcgaagtcatcattcataaattcaaatacaaaaatcatattacctcccactgaaaggggccagaagcaaatccgctatctttaatcattttaactaaaattaccattcctctgttaactgcttgcgcgatttcatcaaaaacttcatcactatcaccataaagatcgctaaaaagttctaacacatttttctgaacttttaatttacagccaacaaattcgcctacagtaaattcgtttccgccaactccagcgtaaaacgtaattacaccagttaatggtctttcactagaacataggtcgtgtgataaattaatataagccgtcccaggcgcagttttaagttggcaacgaatacttactcgagcaattccagctacatgaatgtcagacataatattttcctcaaatagactttttcacaattttccaatcagctttaaactgctcgacgtcagaatggtaaatccagaatcctgcgctttctccatcctcataaagagggcatctatcacattcatcttcccatcccatatcacgcaaaagatgttcagctttttcaacaagttcagaatctttaccgatgatattaaaataccatttacctctaacttctgaatctttgatgctttggcgttgtaatctcattttattctcctcagtagttgatagggtaatagtatcacactactaccctgttgtaaacaattatttttgaattttatcgagccacttaccaagcttaatcatttctttagtagccttttccatacttctgaacttaaccaatagaggataggtatcgacacccataactaaactggttacaagactgtgttcacccacaagccataacgaatacgtttgaatatcgagcccgtaatttctgtctttgtggacccgtacacccatcacttcaaatttctcactagctttttctaccgcatccaggaaatcatctttagtcatattaggccttaaaagtttttcgcaaaagttcaatgatttcatctacattgttttcgtcaacaatgcagtgaatttttgttacgccagaaaccttgtctttgacttcatcttcttcagaagtcggttctttatactcacgaaaacaatgaaattcatcttcgcaaatttctaaaagtctatctttaaggtaaaaatgctttccatttgcgcattcaatgtgttttactgctttatatccattagcgacggaaacttctttaacttcaaaccatccgccattatctcgaatagctttaacgattgatgaattagaacgtgggctataattaataaatgtatcaataagtcttggaacaagttcatactttttgccaatatacattacgtttcctcattttgataggggcttgatagccccttgataattattgttcaatcagtcccatgtaaaattctgcgtcttcagaatccatgccatcacaatattcattagccataaagcgggtgaggtcttcaagaggaccttcaacaacaatttgaatactccaaaatttagaatcttgcacacttgtgatactaagttcaggataacgattacgaataatctcttcaatatattcaaaatcaacaatgtcaatatcaactttagccatattattttcctctttaatcatcagcagtattgccgatagttgtatagtaccatggaaggacaaggatgtaaaccgttttgtgaaaaaatttttgaaataaaaaaaaggggacctctagggtccccaattaattagtaatataatctattaaaggtcattcaaaaggtcatccaggtccgtgtcatcagcactagatgaactaccagagcttgagctcataaaatcatcttcagtttttgtattgaagtcatcaacattgaatgcatccaaatcatcggcaactttatcagctttcttagcagcagttgcagcggcaccgcccatcacagcagttcccataacttgaccgaatttagtgctcagttcttcaaatgatttgaatttatctttagaagtcatttcagaaaggtcaaccatttgttcgaacagttctttctggaaagattcatcgtcaatgtttggaatcgcagattgattcaggaatttagattcatcgtagttactaaatccagaaacctgtttaactttcagtacaaagttagcaccttcccacggacaagttacatcaactggagtttcacccatttcaacatcaaccgcaatcatcgcgttgattttatcccagattttcttaccgaaacgatatttaaatactttaccttcgttttctggagcagctgggtcttttacaacaagaatgttagcccagtaagaagttttacgtttaacaagactgtactctttattgtcagtgttgtacagatcatttttactaatgtattgacatactgggcaagaatcgtaatcaccgtgggtagatgaacagttttcaatataccatttaccatttttcttgaaaccgtgatttacaagaattgcgaatggtgcttgttcatcatttttagacggaagaaaacgaattactgcttgaccgttacccgcattatcgagtttcagtttccactcgcctttatcttcagaagaaaaaccacctttatttccagccaatttagccatttgtgcagcgagttcagcagtagatttacgtttaaacatttttatttcctttttaatttaattaacagttggtgctatgacgatgtatgacctcatagctggtcagtgagataattataatctatttataataagcaattaatacttacaagatttcacagtttcaatgaaaacacttttagctttctgtgaatcaatatttaaaatttttctataagcctttaactttatagaataattattccagactaaattatcagtctgttcatcgtgtttatcaattatatttaaaaatgaatcaagcaagataaacgtctcaaacgaaattatgttcgattgcagaagtttaaaaatataacttgactgaacttttggattatactcaaaaatttctttaaaagcagaaacttcaacttttttactaaaataataaatgttgcgaatatcttcttcaaacttaaatttaatttgctttaagcgtccgatatattcacgataaaacacaagtgcatcagcgtcagagatgtcaccaatccaagcatcttggttagcaaccaaattacttataaagattaaagcaagttcctttaatttatatttttctgataacttctggaaaaaatacttatcccttcgcttttgataagcggcatcagacacccgcatgcaccaattatacttaattacatcatactttccattcatatgttgttttatcattaagtataatttataaactgatttaccatcaatgtatctttcaccaccagcaggcatgcggagtttaatcatagtagaaaatctaatgtattagttttttcacaacgaacaacagaaggacgtaaaagattttcgtcaatggcttctgactgaattttttcaattatacccgaaggaataaatttagcaaattgagtttcaggaatagaattttcttccaagaatgctgtcgtagcttcaagataactcattccaaactcttctaccattttttcaataataaatccattttcttgacgatcaagaagctttgctatttcatccttttctttcttaattgaaagttctttttctgaaagaccggtctcatcgaccggacgaatatcatttagagaaaactgtgtcataaagttcaactacctcttcagtttcagcttcaaacacatcacggttatctttatgatacaaagctaatagacgattaaacatcttaccatcaacgccaagttcatctttggcacgaattcgaatatctttaatcagttcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacgattgaagttttcattgaaggagttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttatgcatcggtgaccattgcttaacatttgggtatttgtgaagctgtgtaaagtcaccatccgatgaaatgattaaaatcttgtgtccttctaaagagaactttttaacaagaacagcaatgtggtcatccgcttcatacttatcaatatccataacaatgtatggcatataagctttcaattcatctataactttatggctggattcaaaataaccttcccagtcccaagtagattcttctcgtgcttttccacggtttttcttgtaataatacgcaaaatcacgacgccagtatccagatttcgcgttatcaatacacagtacaattttagtgtatccaagagcttttgcttttttgacattaaacttaattgagttcaatatcaaatgacgaaccattgataaattaattttttctttatctgggaagtttaccaaagcagttgaaagcgcaatttgactaaagtcaattaagcagattccttctttgtaatcttcatccagcatcatttctaaatccatatgaacctcgttcaattagtgagatttctattatataccatccaaatcttaaagtaaacaagtataaatacttattattgaaaacacaataggagcccgggagaatggccgagattaaaagaaagttcagagcagaagatggtctggacgcaggtggtgataaaataatcaacgtagctttagctgatcgtaccgtaggaactgacggtgttaacgttgattacttaattcaagaaaatacagttcaacaatacgatccaactcgtggatatttaaaagattttgtaatcatttatgataaccgcttttgggctgctataaatgatattccaaaaccagcaggagcttttaatagcggacgctggagagcattacgtacggacgcaaactggattacggtttcatctggttcatatcaattaaaatccggtgaagctatttcggttaacactgcagctggtaatgatattacatttactttaccatctactccaattgacggtgatactatcgttctccaagatattggaggaaaacctggagttaaccaagttttaattgtagctccggtgcaaagtattgtaaactttagaggtgaacaggtacgctcagtactaatgactcatccaaagtcacagctagttttaatttttagtaatcgtctgtggcaaatgtatgttgctgattatagtagagaagctgtaattgtaacaccagcgaatacttatcaagcgcaatcaaatgattttatcgtacgtagatttacttctgctgcaccaataaatattaaacttccaagatttgctaatcatggcgatattattaatttcgtcgatttagataaactaaatccgctttatcatacaattgttactacatacgatgaaacgacttcagtacaagaagttggaactcattccattgaaggccgtacatcgattgacggtttcttgatgtttgatgataatgagaaattgtggagattgtttgacggggatagtaaagcgcgtttacgcattataacgactaattctaatattcgtccaaacgaagaagttatggtatttggtgcgaataacggaacaacccaaacaattgagcttcagcttccaactaatatttctgttggtgatactgttaaaatttccatgaattacatgagaaaaggacaaacagttaaaatcaaagctgccggtgaagataaaattgcttcttcagttcaattactgcaattcccaaaacgctcagaatatccgcctgaagctgaatgggttacagtccaagaattagtttttaacggtgaaactaattatgttccagttttgcaacttgcttacatagaagattctgatggaaaatattgggttgtacagcaaaacgttccaaccgtagaaagagtagactctttaaatgattctactagagcaagattaggcgtaattgctttagctacacaagctcaagctaatgtcgatttagaaaattctccacaaaaagaattagcaattactccagaaacattagctaaccgtactgctactgaaactcgtagaggtattgcaagaatagcaactactgctcaagtgaatcagaacaccacattctcttttgctgatgatattatcatcactcctaaaaagctgaatgaaagaactgctacagaaactcgcagaggtgtcgcagaaattgctacgcagcaagaaactaatacaggtactgatgatactacaatcattactcctaaaaagcttcaagctcgtcaaggttctgaatcattatctggtattgtaacttttgtatctactgcaggagctactccagcttctagtcgtgaattaaatggtacaaatgtttataataaaaacactaataatttagttgtttcgcctaaagctctggatcagtataaagctactccaacacaacaaggtgcagtaattttagcagttgaaagtgaagtaattgctggaaaaagtcaagaaggatgggcaaatgctgttgtaacgccagaaacgttacataaaaagacatcaactgatggaagaattggtttaattgaaattgctacacaaagtgaagttaatacaggaactgattatactcgtgcagtcactcctaaaactttaaatgaccgtaaagcaactgaaagtttaagtggtatagctgaaattgctacacaagttgaattcgacgcaggcgtcgacgatactcgtatctctacaccattaaaaattaaaactagatttaatagtactgatcgtacttctgttgttgctctatctggattagttgaatcaggaactctctgggaccattatacccttaatattcttgaagcaaatgagacgcaacgtggtacacttcgtgtagctacacaagttgaagctgctgcaggaacattagataatgttttaataactcctaaaaagcttttaggtactaaatctaccgaatcgcaagaaggtgttattaaagttgcaactcaagctgaaaccgtagctggaacatcagcaaatactgctgtatctccaaaaaatttaaaatggattgtgcagagtgaacctacctgggcagctactactgcaataagaggttttgttaaaacttcatctggttcaattacattcgttggtaatgatacagtcggttctacccaagatttagaactgtatgagaaaaatagctatgcggtatcaccgtatgaattaaaccgtgtattagcaaattatttgccattaaaagcaaaagctgctgatacaaatttattggatggtctagattcatctcagttcattcgtagggatatcgcacagacggttaatggttcactaaccttaacacaacaaacgaatctgagtgcccctcttgtatcatctagtactgctacgtttggtggttcagtttcggcaaatagtacattaactatttctaatactggaacggtaactcgtctgatttttgagaaaggacctcaaactggaactaacccagcgcagacgatgactattagagtttggggaaatcagtttggtggcggatcagatacaacacgttctactgtatttgaagttggtgatgaaacatctaatcacttttattctcaacgtaataaagctggtaatattacgtttagcattaatggtactgtgatgccaataaatgttaacgcttccggttcattgaatgcgaatggcgtagcaacatttggtagttcagttacagccaatggtgaattcattagcaagtctgcaaatgctttcagagcaataaacggtgattatggattctttatcaggaatgatggcggcagcacatattttatgcttactgcatcgggtgatcagactggcggatttaatggattacgtcctttagctattaataatgcatctggtcaagtaactattggtgaaagcttaatcattgccaaaggtgctactataaattcaggtggtttaactgttaactcgagaattcgttctcagggcactaaaacttctgacttatatacccgtgcgccaacatctgatactgtaggattctggtcaatcgatattaatgattcagctacttataaccaattcccgggttattttaaaatggttgaaaaaactaatgaagtgactggacttccatacttagaacgtggcgaagaagttaaatctcctggtacattgactcagtttggtaacacacttgattcgctttaccaagattggattacttatccaacgactccagaagcacgtaccactcgctggacacgtacatggcagaaaaccaaaaattcttggtcgagttttgttcaggtatttgatggaggtaaccctcctcagccgtctgatatcggtgctttgccatctgataatgctacaatggggaatcttactattcgtgatttcttacgaattggtaatgttcgcattattcctgacccagtgaataaatctgttaaatttgaatggattgaataagaggtattatggaaaaatttatggcagagtttggacaaggatatgtccaaacgccatttttatcggaaagcaattcagtaagatataaaataagcatagcgggttcttgcccgctttctacagcaggaccatatgttaaatttcaggataatcctgtaggaagtcaaacatttagcgcaggtcttcatttaagagtttttgatccttctacaggagcattagttgatagtaagtcatatgctttttcgacttcaaatgatactacatcagctgcttttgttagtttcatgaattctttgacaaataatagaattgttgctatattaactagtggaaaggttaattttcctcctgaagtagtatcttggttaagaaccgcaggaacgtctgcttttccatctgactctatattgtcaagattcgacgtatcatatgctgctttttatacttcttctaaaagagctatcgcattagagcatgttaaattaagtaatagaaaaagcacagatgattatcaaactattttagatgttgtatttgacagtttagaagatgtcggagctaccgggtttccaagaagaacgtatgaaagcgttgagcaattcatgtcagcggttggtggaactaataacgaaattgcgcgtttaccgacttcatccgcgataagtaaactatctgactacaatttaattcctggtgatgttctttatcttaaagcacagctatacgccgatgctgatttacttgctcttggaactacaaatatatctatccgtttttataatgcatcaaatggatatatttcctcgacacaagctgaatttactgggcaagctgggtcatgggaattaaaggaagattatgtagttgttccagaaaacgcagtaggatttacgatatacgcacagagaactgcacaagcaggtcaaggtggcatgagaaatttaagcttttctgaagtgtcaagaaatggtggtatttcgaaacccgctgaatttggcgtcaatggcattcgtgttaattatatctgtgaatctgcttcacctccggatataatggtacttcctacgcaagcatcgtctaaaactggtaaagtgtttggacaagaatttagagaagtataaattgagggagccttcgggttccctttttctttataaatactattaaaataaaggggcatacaatggctgatttaaaagtaggttcaacaactggaggctctgtcatttggcatcaaggaaattttccattgaatccagccggtgacgatgtactctataaatcatttaaaatatattcagaatataacaaaccacaggctgctgataacgatttcgtttctaaagctaatggtggtacttatgcatcaaaggtaacatttaacggtggagttcaagttccgtatgctgtaaacaacacaaacccatgcggtgtttatccaggtaacggtgataatgctacttttgctgtagcaaatatcgatattgtttcgtggaatggtattggttttaaatcatcacaaggttcagcagctcgaactgttgtaattaatgcacgtaatggtgatattagtacaaaaggcgttgtgtcggcagcaggtcaagtaagaagtgatgcggctgctcctatagcagcgaatgaccttactagaaaggactatgttgatggagcaataaatactgttacggcaaatgcaaactctagggtgctacggtctggtgacaccatgataggtaatttaacagcgccaaactttttctcgcagaatcctgcatctcaaccttcacacgttccacgatttgaccaaatcgtaattaaggattctgttcaagatttcggctattattaagaggacttatggctactttaaaacaaatacaatttaaaagaagcaaaaccgcaggtgcacgtcctgctgcttcagtattagccgaaggtgaattggctataaacttaaaagatagaacaatttttactaaagatgattcaggaaatatcatcgatttaagcatttctgctggtggtaatatcagtggtaatattactcaaactggtgattatacacagactggaaaatttaatttaattggtccgcaaattgtagaaagcggtggatatattgagtttaattatcgtactactggaagtggggcttggtccggtcaacatactgcgaaagctccaatttttgtagatttaagctcagctacttccacatctgaatataatcctataattaaacagcgctttaaagatggaactttttcattaggtactttagtttctgaaggttcgttgaagattcattatatcaatgaatctggcgattcgaaatattggacgtttcgacgtgacggcggatttactgttgacggtggaggtttaggagtatcaggaggtagtataactacatctggaaatattgcagctctcggaaatattacttcgcctcagattaatactaaaaatattattttagatacaaaagcatttggacaatacgattcgcagtcattagttcaatatgtttatcctggaaccggtgaagaaaacggtataaactatcttcgtaaagttcgagctaaatcaggcggaactatttaccatgaaatcgcttcagctcaaaccggtaaaaatgatgaaatttcttggtggaccggaaatacacttactactaaattaatgggtcttcgtaatgatggcgcaatggtattacgtcgttcacttgctattggcacaattaccactgacgaaaatactaacaactatggttctcctactccaatgggagaaagatatattgctttgggcgatgctgccactggtttaaaatacattaagcagggcgtttatgatttagtaggtaattggaattctgttgcgtctattactcctgatagtttccgtagtactcgtaaagcgatatttggacgttcagaagaccaaggcggaacctggacaatgcctggaacgaacgctgcctttttatcagttcaaacacaggctgatgaaaacactgctggagacggccagacgcatattggctataactcaggcggaaaaatgaaccactatttccgtggtaaaggcaaaactaatattaatactcaggaaggtatggaagttaatccgggtattttgaaattggtaactggctctaataatgtaatgttttatgctgatggcggtattacatctgttaagcagctttcaatatataatggcatatatttagcagctaataattctactgctgggctaacattcgctccaactactacaattgatggcactaagcaaattttgtgggaaggcggtactcgtgctggtcagaataaaagctatgtaactgttaaagcatggggtaattcatttaacgcatctggcgatcgtaatcgtgaaacggtttttgaagtagctgatggacaaggatattatttttattcacagcgtgtggctccaagtggctctgaaactactgggcctgttgtaacccagttcaatggacaagttaatgctagaggaagtattattactgacggaagttttaaagttaatggattaagcactttagtcggtaatgttaccatgtctaatggtttgtttgtccaaggtggttcttctattactggacaagtaaaaattggtggaactgctgatgcattaagaatttggaatgccgaatacggtgctattttccgtcgctcagaaacagcattacatattatcccgactcctaaagatgccggtgaaagtggtggaataagtaatctccgcccacttagtattagtcttaataatggtatggtacaaatgcgccattctgttacgttaggcgatgatggcgctggcggtaatatgattactgtggacaacgataccaaacttgttgttgttactagtcatagtcgtatttctcctaattaccgtatgcaggtaggacaagcagcttatattgatgctgaatgtactgacaccgttcgcccggctggtgcagggtcttttgcttcacaaaataatgaaaacgttcgtgctccgttctatatgaatattaatcgcacagatacaagtacttacgttcctattttaaaacaacgttatgttcaaggaaatagctgttattctttaggtactttaataaatggcggtaacttcagagttcattatcatgaaggtggagacggaagttcaacaggcgcaattataaaagatttaggctgggaatttacacgttctggtgattttatatctcctaagcgcatttctgctgggggttcagtttatttaggtacagacggtaacattactggtggttctggtaattttgccaacttaaatagtacaattgaatcacttaaaactgatattgtttcaagttatcctattggagctccgattccttggcctactgatacacctcctgaaggttatgccataatggaaggtcaaacatttgatgttggcttgtatcctaagttagctgcggtgtatccttccggctctctgcctgatatgcgcgggcaaactatcaagggtaaaccatctgggcgtgctgtattaagtacagaagcagacggtgttaagtcacatagtcatagtgcaagtgcatcaagcacggatttgggtactaagaccacatcaagctttgactatggtactaagacgacaagtagtttcgactatggtactaagaccagtaataatactggtgctcatacgcatagtttgagcggttccacaaacaccgccggtgcgcacagccacacaagcgctctttatgcgggaagtaacaactctcctggtactggttctataagaggatccgccggtggtggtaatacgcttggaacttcttcttctggggcacattcgcactctatatctggtactgctgcaagcgcaggcgctcacgcgcatactgttggtattggtgctcatacccatactgtaggtatcggtgctcatacccacacggtagcaattggctcgcatggtcatactatcactgtaaatagtacaggtaatacagaaaacacggttaaaaacattgcttttaactatattgttcgtttagcataaggagaggggcttcggccccttctaaatatgaaaatctatcattattattttgacactaaagaattttacaaagaagaaaattacaaacctgttaaaggtctcggtcttcctgctcattcaacaattaaaaaacctttagaacctaaagaaggatacgcagttgtatttgatgaacgtattcaggattggatttatgaagaagaccatcgcggtaaacgggcttggacttttaataaagaagaaatcttaataactgacataggaagcccggttggtataacttttgatgaacccggcgaatttgatatatggactgatgatggttggaaagaagacgaaacatataaacgcgttttaattcgcaatagaaaaattgaagaattatacaaagaattccaagttttaaataatatgattgaagcttctgtcgcgaataaaaaggaaaaattctattataaaaaccttaagcggttctttgctcttttagaaaagcatgagcatttaggtggtgaatttcctaaatggcctgaaaaagaacagaagccttggtataagcgtttattcaagcattacgtataaatatcttaaaaggagggtctatggcagcacctagaatatcattttcgccctctgatattctatttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatacgaaggaagattaccttcaacaataactgaaaaatcacttggaggatatcctgttgataaaactatggatgaatatacagttcatttaaatggacgtcattattattctgactcaaaatttgcttttttaccaactaaaaagcctactcccgaaataaactacatgtacagttgtccatattttaatttggataatatctatgctggaacgataaccatgtactggtatagaaatgatcatataagtaatgaccgccttgaatcaatatgtgctcaggcggccagaatattaggaagggctaaataattatttgttcgtatacatctctagatatcgatatacaccctcaaaaccctcgttgaattcgtcgatgagggttttcttatcttcttgggttaattcagaaacaattttacggaatgaattttgatttaactttctaccttcatgcgttactccaatctcattcagaaatgcaataaaattagcacgattttcaacaatatcttctctggaaaatttaatcaaaatagacgcaacagtaataatttcacgaactgtatcaatgtttttattcattaactataccactcaattagttgactttgttataatatcatcagacgtttgatttgtaaactggtctgtattattttcttcaaaaattttttctacgaattctttgaacgactcacgttcctgagctacattatgctcgattactttttcaagattatgactcattcgaaataatcttcaatttcataatcatggacataaatcattatagtttttaatacatcatcgatactttttcctggagctggaattacgtaaaaatatcctgcttttgagaggtctttataagttccaatcaagaaatcattattctcaagatgcagttcttcaactaattcattgacaattgaatggtataaatttggtagaaacttatatagcttttctagaatatcaattttgattgtgtattgaaccacggactgagaatcaataatcatagaccttccccttatgtttctgtttgcgattagattctttaaacgctttcttcttatccttatgaacagaagctttattaaaattatgttttgcgactaaattgttcatagtgctgaattacctctctcaaacatttgcatgtgaatgaaaactttttagctacaccacattcaaatatatgttctcttaaatcacgtgtatcggtatatcccatctcaacaataaaatgccgtattagatttttatctttatcattgagagaattaaaataatcagattttgaattaatttccctggccaaattgaatcaccttcagttgacgttttagttcttttatcatctcttcgttcatcgcaatataaagatcgcgtaaagcaggctttagcattccatttattggggaactaaatggacatacataatcttttcctacgagctttttagtgaattccatattacagaactgaaatgccggttcattggcataaattccccatttggttgacatcattttattggcatattccaatgcctggatttgattcataattccatcaatttgaaactttttaatattcattagtaaaggtcctcagagtaaagttctttttcactaccaccgcgttcaatacgtacttgtccagcgtaagttgcaataatcattgcttcttcacgtgtccaataattactatattggtcaataaacccttggtcatcatcacaaacttgttgagtaactaattgaggtttaactacatctaaaactgctgccatatctttagaataatgacgagcacccggaataacaagaattcgtccatcttttaatttaaaacggttggctgcgcaaacaatccgtcgttggtacttttggttttcatcccagtatgcagactgccaacagatttccggaacttctgcaagaatatcttcttctgtgcatttataaccatgtgctttaaacttttgaacaagactttctggagtctcacgagataaaggaatattcaacatttttaaacgattaataaatgggttcatttaaaccatcctttaatacgctgccacaaagttttctgttgagctttgttaacaccaattgagcgaataactggttgagattcctggaattctttataatcggcaaggtaaatttcgtaagctgcatccgtaaatgaacttatcgctgccataaaattattgcgaatacctactggagcatctttactttcacgaataatcatgtatttaccagtcttaatctttacaatagttccaagataagctccatggtaccaaatatcccagccctcttgagtaggttctgcgcaacgacgaagttcattgacaatttctaacttgttcattatttattcctcacagttcagatgctacagtgattacagcttcaatgttttctactgagcgtttaatgtcaagatacacattaccgtttttagcgattttacatgacattccgatatcagtaaatttctgaatatgatgttccatcattttgtatccaaaaattcgcatgtttccattgttgttaatttcaaaattacgaattccgtgagtgcgtttttctaaaatagcgagatagttactgcgataagtttcgacctttttaagaacaaatccattttcatctaaaagttttaacatgaggtctttatcttcttccatatcagaagtaatctcacgagctttacgagttgctcgttttttcagcagttccggagcattttcctgcgcgtataaagttgctgcgtttgaaataatatcctgagcttcacctgtaatgattaatccatcaccagatttctccaccaggccttttttaatcaataccccaatattactattaactactgcgttacctaaatctggatgcacctcacgaacttctgcagctgtaatgaaatctttcttagcaatggtaattaaaatcgcagcagttttttcattcagaacatcgttagaagctttgatgatgtaagttactttagacattttctaatctccgtaattctgtatcagtagttgatagttgtatagtaccacagtatgctttggttgtaaaccgttttgtgaaaaaattttaaaataaaaaagggagagcctcggctctccctaaaattactgcatgacagttatcacagtcatgataacacgttgaattccgaacgcaagaagacctcctgctatggctggaacaacgcctaaacccgccagtaaaatgctaccagatactaatgcagcgcttgtaataccaatgaatggactcatttgatttcctctaaatctttggtgtattcggtaactacatcagtagttttccaatattcgttttcttcttttttagctttagcttcttcagcaagtttctttgcttcatcggaagtcatatgaaaaatattcattccaactagtttatcaacataagaagaatacatatcgattttcgaaagttcttcggtcagttctttacgagttttaccctgtacaacaatttcacctgaaattactttcttaatgaaatgtgccttggcaaaggctaaacgaaaagctgactcagtttctttgattttgttatcaattcgtttttggacataagttttacgaacttcaacaaagtctttaattaaatcgactacgttatcgtaaacttgtagttttcctttctcattaataaccgtaatattctgagaacgacgctcaatcaacccaaagtctttcataatttttgcatggcgttcttcttcattatcgctcaaagaatattctttacggaatttaactttaaagccaaaaccatgctcaccacaagcatcatcccatgtaatgaagcctttatcttcaagtgggtctaagattttactcacataagtttcacgatcatacttatacggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgcagtacagctttcttaacagaagaaacactatgaggaagaatgtaagttgcataaccagttgcaataccggaaacgccattaagaagaacagtaggaataataggcaaatagaaagcaggcggaatgtgttctttatcttgatgtaccggagcatattcagtatctttatatacgttatagaaatttttacttacacgagcaaaaatataacgacttgctgctgctttttggacggtacgagaaccaaagtttccttgaccatctaacagaggaaaattattattccaagtgttagccatcaaagcacctgcgtcttgcgcagagttttcaccatgatgatatccaaggtccgctacaccacctgcaatagaagcgagtttgtgaaatttatctttatttcctcgtgccaaatcaagagctcgagcaataacaaatcgttgaactggcttaaatccgtcaatcatgtttgggatagcacgattttcaaccgtgtacatagcataagccaatgcttcattatcaatgatactttttaaatcgcgattattcagttgcataaatttaccatactagtgaatgtagtgccataataacatcagaaatgaaaagcacgacttgaattaatccgaacattactccataatatagtgctactaataaagtagcaagggctaatgaatagcccaagattttcttaatcattagtagataacaacacaaatgttaaatatgcacacataccctgggctaaagcttgtgaaaacacactgctagcatcgatacagatagttaaaacacatgctactatccaacaaataaatgaaataactcctaataattttgcgatattcatattttcctcactggcgtccgaagacgcctttagttttaagattgttacgataaaactgcatcacatgttcgttgtggaaattactcattaatatgcctgcaaaacgaatttaaagttatcagccaacatacggttcatttcttcaagtgtttgatactcagaatgatgattacgagtaaacgccaaagctaactgacctttaccaaatcctgtcgtcagaggtttcatcttagaagcaggcagataaaatactgtgtatggaacattgttatttgcaatagtacgcgcaagttgagaccggcgttgacgaatatgacttagaactgcgctgaatccttgcttagaacgctgattacccacataaaatcgtgcggatacgcatgaaccatcgaattcatttactaaaaagtaaaatccaggtttagataaaatatctttatgcggagttcccaaaaaccactcaccgcccttgattgtaccaataacagtagcgcctgcgttgttcagatcagtaacagccatatatttcattttaatttcctctaaattattttctactccaaggccgcatgaatacatacggccgataaattaatcgtcgcagtcgacgctcaattcccaaaactcttctacagtataagtttcagtatcattttcaatacagaaacgttcattactattatttgctaaagtagcattaactgtcggtttctcgctagtgctcttaagaggtgaaatacgaattaactgatcaccattatctaaacagaaaatttcaccaacttttacatctttaaaacttttcataattcacctcaaggagtataaaatccaaatgcagttgttgaccatcccatccaatatgggaaatttgcaccaatgtaaaacatgagaatataaaaccaaccactcagcaaattcatcattttacaccattccaaattgtttcaactacggattttaaaccattttgatgaatatccattccgactaccgccatcaaatagattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaagcgtttaatacatcaatcattaaaacgattgggaatatactcaaaactactagtattataactacattccatatagctttaataatctttttcattttctgttcctccgtagttgatagggtaatagtaccacggaagaacagtcttgtaaacaactttttaaaaatattcgtaataaatgtgaataccaactactaccgctgaaacctgtgcaacccaccacgcacaagcaataagtacagaattcaaaattttcataataacctcatcacaaaagtaaatgttaaacaaattactggaatactaattaaccaaacaaaacaccaccataatgaactcatagctcaatctcagcgattttcatttcattactattaatagcctctttaagactatctgaaagaattacattccagtggtcattcatatgaccattaactaagcgtgtaatttcttcaggagttgaaaaataaggctgatcagactcccaatgcgataatcctaagcgagtataaatcatgccttcatcatcgctcgaatattcaactgacacaaactcatcagttattttatgcttagcataataaaatttaaatttcattttactctccaaatccgtatcagttgatagttgtatagtaccacggtccttgtggtatgtaaaccgttttgtgaaaatttttaaatggaaagataccatccgttgtagttgctttttcttacaaccttacgaaggtcttctctgtcaccgatgaacttcggagtgtactggatgacacctggatgaatttctttagtgttgaatataattatacagtcggcgacttgatgatttagaatgggccctagatttattccagaaccatatggatactctccgctgcatcctgttgttaccgaaatccaacgtgagtcagtttgatgtgtcttaacttctacacgaagcccacagtattttggatgcgccaatacatcccatgcgtatgtatacgggtcattaacatcctcttggcctttattaacatacccgcttagccaatctgctacaaaaaattctgcgtacacagcgatacggcatctttcgataacttctgccttatcctgatttggattttgttttaaagagtatcttgctgtatcagcaattttgaccttcatttcactagtcaagtcactgttcgatagggtaaatgtcggaatctgaaatagtctctgtaaacccggattcgttttctgcattaaactttccttttacgtcggaatcactgatattcatacaataaatcatagtttcccttaaaacaaaagggtcgaagccccttattttatttgaattgtgcaattcttttttctaaacactctgcgtaagatttcattgagatgaactgtgaaagtagaagttcttgctcaactgcactaactgttagaaactttgtgctttctaaaaatttgctcagtgcattaattttgagcattaattgatcgtattcttcttttactcgtgcttgataacctaacataattttccttagttaagggccaaagcccttatttaaattgttcagtaacgtcttcaactacttcgtattggcaggtacgcattttagcatcgttgtaatcaatcggaattgatactacatcacgtggatgtactttaacttttacaactcggctggttgaactgccaaagtgacgaatataagatttagaacacacatgcagaccacgagaacaagtttgtgtatcatcgtcattcacacgagtacgcggcattttaactactttaccaggactgttatcaaaggtgtttgagtgacagtcaaagtagttgtcacgaactactttccaagcatagaagtaaccatcttctgtaatttcaatatcgtttgctaccaagaaatcaaagagtcgagataccgctttctggcttgggttttccagcagattttccaagaacggaaaataaaattcaaagttttcacctttttccatcgaatcgagaatacgatcaactaaaccagaccgtaattcgatattttgatagaacaagcttccgccttcaattcgaacatcgccggaaatatatttttcaacagcgcgacgaacattaattttttgtgccgcttcttccaacttatctgctacaagcagattaagaatttcctggaagtttgaatgagtattaggagttgcgttataagttacaccgtcaacagtaattgaaatgaattttttagatgcattccaaataatgtcagatttagcaactggagcaataactgcatcgctattaactttaattgtaatatcaccgctaatagtaactttagagcgtttagcttcttcagcatttttcaaaacacgacgaattgtgtcaaccgatacaccttgccaatcagccaattcctgttgggtgtaattaccacttgaatacagcttaacaatttcagcttgttcgtttttggtcaggcatttaatattgtacataattttcctta

SEQ ID NO: 6 - DNA, 166982 bp, Artificial sequence
  Synthetic polynucleotide
  misc_feature: Ec57, E. coli bacteriophage
ttaggccgcaagggccttcatagttttagcgatttgagaaacttcatcatcacttaaagagttgcgataaccgatgaagtcggaaacaatgcggaatttcttggtaaactcagcaaccattttatcactgttttttgaagcattatttgataatacatcaaaaagattagttactgtccagatgtcatgaccgatggtatcttttccaccattaaaatatacaccgcgcaatgaactaactatattagcgagtcgtgtatattcttcagaaacttcatctgtactgaagtacttcatcataaaatctagttcaggatacttgataatgttatcaatatatcgttgagctgaacttgaataacctacgtacttatcataatctacatcatcaaaagcatctacatataaatcacgcaaagcttcaaaaatacattggcactgaccgagttcttttacctttttctgtaaaagcggacgaataacataaaactcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcagggagtaaatcaatctgtgattctacttccggattaataaacagaagacgctcattgtgatgaatatttaaagtgttattaaattcactatcatctaatgcacgtgctaatccacggacaatattaacacgatttttaatattatcaataacgatattaatttttgttgtattaataccaaacagacgataacttgatgcaacggctgaagtttcatgactttgcttaatgcgtttcagtcgagggtcaagatttacttcatacacaactcccgcgttacataacttactatcaggttcaaacatactctgcatcttcttatatgacagatttttagtcgtgaatttgactgaattactaatcatataatctcgagcagaataccccatcttcatcaattcacgatatgtgtgacgaggagatgtagattctttaaatcgttttacatcttcattaaatgctttctcactgagttctttaactcgttcaataatatttttacgagtgcgatcatccagtgaaagagcctcgcgagatggagcaatatcaagtgaacccattggaaacttaatgtaattcacttcattgcgaatgcttagccagttacggtctctaataacaccgtcgataggataaacaataccgccatagatagcatataatccaccgcgatcaggccagtatctttctggatttacgccataataatcatcaaaatccggaaaataatcaatttcgcggtcaaggccattaatgatagccaaatctttgaatggtcgcatgatataagaaacttcataagcaaagtttctaaagtctttttcttcaactggaactacgatttcaataccagttttatcatctggacccatttcttttacgaatgtaggtttaatctgtgggccatcaccatccatgtaagctacataaccacgaatttcacctttatgatacgaagtaatactaaacgtatcagtataactaaacggagatttagaacctaaaccaaatccgccaatgaaatcgttagattcagccttagatgaactgaagtatgaattatacagaccaggagaattatcatcaccctgaatatcaaaatcactcatacccggaccaaaatctcgacaaacaaatcgtggatctaaacgtccaggaacttgtatgataaatttttcaggatttccattgagagcatgagcatcaatcatgttagtaattaattcacggaccactgcgcgaatcttgtttgtatacaaatcagatgatagaattttaaatactttaggatttgctgcgatgctaaatgcttttgatttagaaccattgccaagaattgtttctttttcagtggtgataatcataatttcctcattaattcatattacgcttaataacttcagcaacttctagtagttcatctttagttgcggtatcggattgaattttatctctaatatccttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcgttatctcccatgagcatttcaaaaagctctttccagttctcaggaagtttaacaacatcatatactggattttgaatcatctcacgatattcagatttttccaaagagccaagtcctttaatataacggatgctatgtttaggtagagcatctttagcactctcatattcagcgactgtataaaaccattcttgttttttaccgacctgagcgataattacaggagttttgacaaagcgaattcttccttgctcaaacaattctggccaattactaaaaaatccaagcagagaaggataaatgcttcctagaccatcatggtcagcatcagtcataatagcaatattatgataattcaagttttcagctttttcaccgagaactaatccagtgattgcgcaaatatcaaacagttctttgtttttaagcatatcagcatatgacataccccaactgttgagaactttaccacgcaatggataaccaccatgaagttctttatcacgaacatcaataagatatccgatagcagaatcaccctcagtcaagaaaagagtagtatcagcatctttaccacaaagattcgctttgatatgtttatgaaccttagctttagaagcctttttagctgctttagtttctgctgctttttctgccgccaatttacgagccaaagcagcttcaataatcggcattagaattgcttcattatttagaatagcgcgtgaaatctttttagcatcaagttgaatatgactacgaatttcgccaaatggagaagtcaaacgctctttagtttgagaatcaaatcgcatgtttttcatatcacgaacaaacataacgatagtcaaacattctttaacacgcgctttagttacatcaattttgaacttacgtttgatttgtggaataaggtcttcacaaatatcatccataacacagtcaatgtgatggccaccattcttagtgtgaatgttattgacgtatgttaattgacgaaaaccatccggtgaacgaccaaccgcaatagaacaattttcttgttcttgaacaatagcatgctcatcatattggcgtgcatatttcttaaaattgccctgaacctttttaccattaaaggtaaattgaatatcaggataaactactgcaagtgtctggagacgatctagtgtaatgtcaagataaacttgggacagctcattagtttcaaatgacataaaatcaggaatgaaagtaacacgagttcctttccattttccaggaatagtttcccacgatttattttccatgccatttgaacaacgaactacaatattattttgaccatcaccagtttcaccgacaaacatcacagaaaaaatgtttgtcaaactagaaccaacaccattcataccgccagtgacgcgttctttatcatcaccgaagttaccacctgcttttggaatagtccatgcagcaacaggaccaggaatttcttcaccggtaggtgttttaaccatcgcctgcggaataccacgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacgaatagtcgaatccttgaagaatagtccagaacatactgttccttctactttctgcccagtaggtccaatagcacgaaatccagtatgctggaaatcattttcagagcaaccgaaccaattatatccagtgatttcaatattagtaaaaccacttgaagacaaaactttggttgcattatcagcatcagtacatcctattaaagacactgctaatactaatgctgcgatagaacgattaatatatttcataattttcacttaaatttaatggcttgaagaagactaataactctcaagcggcttctttcatctttaactgtaaaagaaagagggtcaccagatttcatagtgatagtgcattcaaaagcaaaaccttcgggaacttcttcgaagaagtcaaattcttcatcatatattagaacattactctgaaaactgtgaagaatttttccgtcatttccagatgctgtactaatcattgtaacgttattacctttcatatcttcaacgataaattcgcttgtagatattacagcattaatagaaccattcctataaatagcagaaaatagatatttcttttcttcaccttcgcgaatgcgatatttcttaccgattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccatgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtaccatcttcagtgatttcacgaaatacaccgtaaattggttgtttatcaccgactttctcatatacataaaccgaagtcaagtgagtaaacttgatagtgtgttccttttgaactactaccaaatctggatcgaataatacatcttcaaattcatcattagtgcaattctgaacaattttacgtttcatcataatttcctcattaattgaacattggagcgatgcgtttcagaagagtatcagcgcacctttaacgaattatccattttattcttcaagttgttttctgtatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttctacccattgatcagtaatgtatgcacacatagcgcgagtacgctgaggaagtggttgtccaccttcggtaaattcaaactcataaggagcaatgaacttgatagcttgaccaagtttccacttaaagtctacacctacatgcgaagtatcaatcgtttcaattcctttagcaggaacagctttcaaaaacgcaggctcaagaaatttccatcgaacataaccaaactggggcttagacattccatctttagcaatgatacgtacttttacttcagaatcttcatctttaacaccgtgtttaagctgaatgcttacaacttcgaccaattttcctgctgctttagaacgggatttatcagatacacgagcaatttcaccgatattaatattcataattatctctcacttgttaaaaagattttatactccacaggaccattatactctggtcccaagagtttgtaaactagcttacacgaacattaatcactgcgctacgaggaactacagagtattctccagcatgaactacgttcagaagttcaacgccatcttcaatccactggtctgttacccaaccacagataggattatcaaaaggacgacggatagacacagcagcacacaacaggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcatagtaggttccttaatttccagtggtttaacagggcatacataagtgcttacaacatcaaaatcaatcagtttagctaccggatttggtatgtattcaggattataattaaatttcataattatctcatttcaataaaatctacgagttcagcatgcgatttgcggaacattacttggtgcccaccaatgataacttcatcttcaggaacttcgtatacagcgagataaaatcctttagaagataattcttcccgctcttctcgtgtgaaccatctcatcatatcatattcactagcgaaagcaaaatgataaagacctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacgtgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgatggagcatcttcaagacccatagcatatcgcaaagcatacttcatcatcaggatgtctttcgcacagtcatggatagaatcatgcgcaacgaatccatctaaagttccttttggaagaggacacgtggtcatatcacgaacaagtagaagtgcttcaattctggtacgaatatcacgctgattccagaatttacatggttctaacttaaatgtgtcaagctcattctcagaaacaccattaagacgttgaatatcacgaatgagatcgactaaaattggaaaatcaaacgacattccacggcaccagccttgagatttccaaggatcgatattatgtgcattgatgtaatcattaaattttgcaataccatcgatagtgcttacatcttcatctgatggtgcaatattttttcgagcttcaggagattggttcttccaccattcaatagtgcttttagtaaaaagacgatgtcctttttggctttttaaatcaaatttgattttaatgccgcgtgaaactaattcatcaaatgtttcaactacttctgggttagggtcaaaagcaattacagctaaatcaataacagctgccttttcgccgcttcccattgtttcaaaatctataataaaatcaaacattaaattttccttgctaaatcgcgaatttgacctacagtataatcttgaatataaactttattaataggttcatcaataaattttgccatagattcaatatctttttgtatctcttcaagactgtatactatctttgaagctttttcgcgaatagtaatattatcaggccccggattttcctcaatgacagctttaacatttgtcataagagatttaaactgatgcaaacttaattcaatcattaataaccgccttataaagatggctaatttcacctaaaacataatcaccgattgtaacagtttttacttcaccacaaaagaattctaacgcaatcaaatctcgttcaatttcttccaattgaagcattaacttaccagattcaatttttacatttctacgatttttactataagctatttcataaatttcgctcactttatcttgaagaagataaaactgatctttagttatttccacgaatagcttcctcaaatttaattagtaatttacagacactttcatctaatgtaattactgtatctgtattactatgatatgattgtttttcaattcgtttaattgctaatatagtatcacttataagataaagcttatgaaggagctcagctcctgttaccataacattaagattatcttgcttattagtatgcttccttataccatctattagacgatttaaatattttgaattgatgttaatcatatatcctcacacataaaatacgtcataacgaccacgggtaacaccaacataaagaagttgttgagctaattcagcatctgcataatgaatgcaaggcgtataaatgaaagcacggtctacagacataccctgagctttatggaatgttgatgcaggaagtgctttcactttactaaactgtgatttagcatcccaaaaatcactccatggagcttttccgcctttgttccaatttttataagtttctgccgttttacctaaaaataggttaaacttatacagttcttcatcagatgaaattattttaatcttttcacgataatattcatcatcgccataagtttctactgttaaatcccaatgacgaattagatattctccaggaacaccacgagctttaacaaacgtcgatgtatactctgcttctataatacgaactaattgtccgttattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagtgatttgacgattgaaaaataatttaccataaaatcgcgtaaagcggtatcaccagtaaatccacgtactccatgaccgtcaacaactttatcataaatccacttaccgttgcgaacatcagtagctacatcaataataggagcattactgcgtttaacttcagtaagttcacactgataaaaatctttgtgtgtaaagaatggactgatataagcagtattttctcctggatcaacaggtctaatttgcttattatcacctattccaattatagtacaccaaggtggaatagttgaaagcagaattttaaatagctttctatcatacattgacacttcgtcgcagattaataccctgcatttagctaaatctggtacttccttctgttcaaaaagaacgttttcttcatacgtaactgggttaattttaagaatactgtgaatagtactcgcttctttccccgacagttttgaaagaatctttttagctgcatgtgtaggagctgccaaaatgataccagtttcgcctgttgatattaaagcttcaatgatgaacttagtaagagtagtcttaccagtaccagcaggtccattaatagttacatgatgtttcttttctttaatagccctcataacgatgttaaaggcatttttctggccttcggtcaaatcatcaaatgtcatcgtaaattccctgcaattggtatactaacaatacgcccagtatctaaaattcgctgatataatctttgtgtgtctacgtcaggcttaacatgtttaacttctattttattaaaccaaaacttgcgtggagtctcaactaatcttggaattcccttacctaaagctaatcgatactgctctttaagagtagtaaatactttatcagcaatattccattcaaaaaatacagcaggacgatgttcatcaagcggaactggcgccgtaaatccgtctttgtctcggtaaactatcgcatatacataaaccatattatcctcggataagtttaaaaattgaacaatttagcggatatcctcttttcagtttaagtttatcaataaaagacaagttttgataccgctctacaccttgaataattttatcacacatatcatattgcatttctgcctctgacaactttttcacaattttccaatccgagcctttaagaagaacgttcaatttaacaacttcagcgccttctgctatgtgagaaccatcaatacgagctttaagtgctataatccttagcttaatgtcagaggtctgttttgatttagaaagctgagaaatgtgttcaattcggttttcacgttttttctgtatagctttaatttgattataagtctttttgattttagcccatttcttttcatctaaatttagtttatgaacttttttcgcagatgaacgaccaattcgcaaagcaaataaatcacgcttttcaatcaactcctctaaagtataatcagaacgaaatgtattatactttttctttactgcaataacattccctttaatgtatccaacgttattatcaaaacgttctaatgataatttctctccttcaatacgattatcaaaaggttctcctgaataggcacaaactttttgttctaaaatattcttaatataattgaagtctaagttaaaatctttagaacgtctttttgcagatgcctgagtatgctctagacgacgtttaattttacgaatttggttattagacagcttcatatttttctcacatcttacggacggttaactacttatactataacatttttaccttaacttgtaaacaactttatgtaaaaatgctttaaaactttcatggtataatgaatctaagtccttccattatagattaaatccttcaaaatcaagagtatagatagtgtatgttgaatactttttgtactcatatctatctgcaattctaaatacacttccagctggtatcattacttcttgttcatctgaaactaattccatattacgataacgatggctatccggaaacttaaagtttggattgtattctttacaacgtagagcttttatagcatactcctggaaattgaataccataggagctttgaattcaaaaataacttgtgtgttatactctaaaccggaagcaaaatgtagagctatatttttatcatatgaagctgatacgactttatcaaatgtaataatatcaattccttgatttaatacttgcttagtctcagctggaacacctctccaaagaggtttatcgtttggaaccaaacgagatttgattatttcatttaaccaagtatggtcatctggcttattagtaatacaatgaattaaaagttcaatttcagataaattaaacccttcagaaagtaattcttcacgaatagaagcacgcaccgatgcatccattgattttattttaaaatcttttagttgcattactgagtatttcattcaactacctcaatatcataaactttaaatgttccaaatgaatcgtgtaatttttcttttgaaatagaagttattctatactttccaattggaatcatccattcttgttcacgcacaatcatcattaagttatcagtacgctctgaatctagcccatcagtatcttcatacgtgtacttaaactcagtattaggagaagaaagtataatatcgctgatatggtcagaataattaaaagctttatcagtttttaagcgaaatattatttcagtgaaatactcaacataagaaaaaccacatgctgtgtgcaaactagtagtaaatgaatctaccctattcgttgaaaacacttctccaacttgtaaatctttaatgagttcttttgtcgattttgatataccacgatataactgataaggtgatttagttaaatgctttttaacgattttattcaactgccgatgaagagcttcattctttttagcttccatacattgccaaagaattgactgctcaaagtcagtaaatttttcacagacttttttatacatatcatattgaaaatcaacgctttcagcttttatagataactgttcaacatctgcaagattaataatcatgatagcctccgtatacttcagaagctatcatatcatcgttagaaaggaaagtaaacaactttttgaattattttgcccagggagcccaaggcggagggtcaagatggtatgaagctagttcttctagaagagcatctggggcttcaattccataattctgtaatactatacggtactctttcttataatcactagaatcattctggttattcgtagaatgattatcttctaacatctcaaataaatccatattaattcctagcgataaaaaccaaattgacgattagcttcaataatctttctttcttcttcggacattctccagcgtagtccaacatcaaaatgggcccagaccatcttaacaaatgcatttatgtctttaatatcttcaatgatgaatgttttacttttagaaggttgacctgctaaattaagtgctaatttaactttatcatcttcaaacaggttaaaaagaccatattcatgagctcttttatagcctttaatagttaaagcttcagaagaagaaaacggtgaatcagtattctgcaaaatatcttcagtatgctttataattagaataatattttctggatattttctttcttttatatctttaattaaaaaatccggattttctgctaaaggaataattaatgagcatttttatcaagtgtatttactgatttaccttctttagacataaattctattgaataatgttttgctacttcaatcatgtgatttccttttgcctactaatggaccatcgggaattttgttttcctggatatatttctcattttcttccatcattttactgccaattttaagaagcaaatccagtgcttcatttgcttttgctttagcctcttccaatgtcatatctttgttcatgatttatcaccatagatgtctctcatcaatttaagcgctgagcgttctaatttcttttctttctcagcactaatcattgatttcatccattcttccgattcgttctgcatttctttatttgcttgttcaacccaaccatcgtcaatatacatcgagtttggtctattgaaccattcaagaatcttcttgagagctttcatttattttacctaaaacaatagtaggagcatcgtcaaatttatgaatttttagtaaatttggatttaacttattccataaagaggtaataaaatatgatagcgcactttcgtccgtaattataaatttatttcctttatctattttccaatcatatattgaatcatatgaatagaaggataacggtttattattataatatgcttcactaacatcaatatagttagatttagtaaatgcttgaattgccataaatggagaattttgtacagtttcaataattccgatctttttaagttttatttcaacatcttctggaatttgcattgaaataaaatcttctactagatacatgttattgtcatatcttttatcaatcattactgctacggtaattggaacatccttgacaaacgccatactaatactattgatagacatttcaaacaaaattgcttccataattttcctcaatcacaagatgtagatgaacaactagaatcacaagaacttccacatgaatcacctgcccatacgtgaacaggaacatttgtatcatatgaatcagaactagactgtgttttctgtgcattagatgatgtagtaggtgttgaccagcgccaaggatttttataatattcttgggcttcttcataagtcatagtaactgcttctactgttccatctcccatataaacatactcaactacagttaaaggaaggtagtcatttgaaataggaactacaccttctccgggagttgtagagaaaaaatctgtaaagaaacttttaaaccaattaaagataaacattacaaaaagcctttcttgaattcgacttgcttctcaccataatcatatcgaatttctgcattaaattcgacagaaccatctgcgtacatcataaatgaatgcacaacaacttctgtagaccatggttgtagttcatatttcttcattacgtgtcgtgaaatgataatatctaaatcttcattcggtttaatccaacgatttaacatagcgctctcctctataagataattctattataccatactcattttggaaagtaaaccatttaaatgaaaaaaggactcccgaaggagtccttgaattattaaccaccagttactttccacaaatcttcgtttgcagcaatccattcagtacgctgattttcttcatatacagtagtatatgctgctttttctgaagggaacgtctggtaatgagcaccagaaattttgtgaacgtcagaataaagagggaaagctactgaaatttcctttccttcaattttcttatttccatctaatttctgctcaaatgttttgatattaacataaccgcgagtactagccatgtaattctccttttatttaaattacatgattatttataataaattctcgcggcttttaagacgagctgttaataacctcggtcttgacgagcgaaattttcagcatttttcagataataaagtttaaagatttcttcagccgtaagaccgaggccttggaacatgttcagaacgaaatgaagaatatcaatcatttcgaatttaatttccaactggtcttgtggagacaaatcagtaatcagagtttcacgtcgttcaccatgttgagctttccaaggcttccatacagcagatgcatctttttcaccattgctcataccaccaagagaagtcagaagttcgcggaattcatcatcaatataatctttctgattacgcagccaatcaacaacttcacctgcagtagccaaatcatcaggatgacggttatattcaggtttatctttagctaaacgaatctgcagagatttctgcatgtcaagcattacctgcagcgggtctttttcatcaccgagaatatcccaatattcattttgagctttatcagcgccttcgatcagttgactacattcgttaaagtaagccattatttttcctttcaattcatcaataagttaaataattatatcatttgagtatgtaagcaattaattaaaaatatatacttcatcagttccattcttttctttggaatgatatatgttaaagacgtattttttattaagatgcttaacattatattttttagaccattctttaagaagagtgttttcctttccgtgatgctctaaaacattcgacagtccaaattttattcctctgtcatttaaagaatctaaaagatttaaaaggtctttttcttcttcttctgaccaaaatttattataatcagcaactgttataagatatggagggtccacatatacaaaatcgccgtctagaattttgacatctttaaaatgcaatgaactaaagattattttatcacaattttgtttaaagtgattaaagcgtttttcactatttttgtttatagttctttttccaaacggagtagtaaaatttcctttatcgtttatacgaatcatattactaaacccgtgaaaatgaagaacataaagtaaaagaggatctctagttttattataatcttcacgtaatttcaaaaactcttcttttgatgtttttgatagtttatattgctttattacttttaatacgtcatcccatgatacattaataagacgcttatacatttcaataattggttcttgaatatcattggccaatacaggaccattgacgttcaaagacactgataaacctccacaaaataaatccacgaatctgtcatattttggaaaatgaggcttaagttcaggtaataatgactgtttattacctgtatacgcgatagctcctagcattatattctctcatttattgcagcaaaaaacgaattatataattcttcatcatatgtatttgataataatactaacacgttttgtgatttagcatattcattaaaccttgcttggatggttggattatcagtaaatgattctctttttgtccatttattacgtggataatatccgcatggcaaaaaatctaatatcatcaatgacacagggttttcagtttttgtgtattcttttaatttctctttatcttctaaatatattccaaccgaatcaatagctgtacctccaccaacttggtgtttaatttcaattatatgctttttaccgttgcgagaaataacaatatcaaatcttctagtacgcttcttagttataaaattagaacaaaacaaattatttgatttttcagtatcatcggttaaaaccattttttcttgataactaactgaacaatcagtgaaatattcttttactttattaagtatgaaattttcaactacggcagatattttatatgaatctccgtttaaagccatttcatgcacaattttattaatcattatatcatcctcagcaatttattttataataccataacaagctgagaaagtaaacaaatttatgaaatttgtgataaatattaatttaaaggaggacacatggcacaaaaattaatggcacttgttgatgccataaaaggtaataaaaaacgtatagcttttactatttctgctatggtaggaattttactctggaactttattttatcacccattgcaattgcacatggtattaatattccagtagttactcttgatacattcgtagatttagcatttgctttagttgggttaatttaaatcttagcatatttagataaccgcattttagccattaacccctgggcaatattatttttcatatattccataatttgttcaggggttgcaccttcctttctaatcatatcattaacatcttttgatttccagggagatttatcccaaaacataaccctttctcctgcattaactaatttagtcattcgcttgatagtgtcagggtgacgaggctcattatctaaaacccacactcgtctatctttaaatggaacaacttctaggtctaattgaccacccgtaatagctataccattttcaataaaaagtgaatctataggtccttctagaacatatacatcaccatctttaactcgttcgactccatatatttttgttgcctcaggataagctttgatggtgatatatttttgaggagcatctttctttaatgcacgtccttgaaaagactcagcttttccattagcattataaattggaataacaagacgaggctcagaaatttcctttttgtatgttcccggtgctatgctattaactaatttaggccattcggttgtaaaccaaagatatttccatttatcctttggaatacaacgagcttttacatattttataattggatggtcttccgccagtttatctaatctaacacatgacggaagagatttaattattttcttctcaggatgtttaggaagttctttaggtttttctactggacgacttttacctttttcttttcttatttcaaagatatactcacgatataaatcaggttcaaactcctttaaatatattccgattggcgcatgatagttacagttataacaatgaatatttccttcattattatcaccataataccatccacgcgctttattttggtcggtttttgaatctccacaaactgggcatctaaaccgtaatttaaaagttgaactattatttacttgtgtgaatttaggtaaatgagctaatgcacgatatgcaaactcattatcaatccaagctattgatgacattctttactcttctttttctttagattcctcttttttctttttaggaatctgttcaggacctttatttactacagcacctgatgttgttccagtagagatattttcaggattaccacctgaatctccagcaaccatatcttctttaataaattctttatatgttttcatattaacctctattcataaaagcattaaaaatttggtcatcaatagatggaatagcaaccttttcggcatcatttagcaaatcattaatttcatcagatagcataacacatgtgcctttatttcctgtaattgttactgcacaattacgaacgttttctttattaaattttaggttaatattttcgtaatgaaaatcctttaatgctgaatatatttttaaaataaaattgtcttttactacaataaacccaacctcactattaaaacgtggttcatggaaactgtaataaaccttttcatctataaaatcgtatgaaattttttccatttttaaatatgaaaattcagaactatacatactaacctctaattactcacctaccacttcagcgatgatatttttattattaaagtttttatcgcaatacagaacataattatactgcattacaccaccagacttaagctgtttttgcacttcggctttcatttcaggacgatcgcgctcaacgatattcataatatctgcttcaatttgagtttcaacctcagtctgatcagcagtcatagaccattcgcacaaatctttatcataacctgccatagcaggctgagcagcacaagaagataaagcaaaaattgtagcaaagataaattttttcatgataatctcctcagtagtttatgtttatatagtatctcaatttccaataaaagtaaacagttattttaaaacttctgcataatcacatgttacaaactgtttctctaacttggcgattttacgaaagtatcttttgcattgacgaatctgtcgctttgtagggcgcacagcaaacttaataaattccactcgaccaaatggagggctttcttctgccggaatatctaatactaattcccacgtatctgcaataagtgctttgaattgagtatttttcctgacattatacggagtaggtttaaataaaacgatatgcatattatcctcggcaatccacttcacataccttcttgtcatcaatgaaagctttaactagtgctttattaacttcagcatattgagtagtagcccattgaacgtcatctttcatcattgtgatctctttagtaaacatgctttcgttcttaaaccaccccataaaaactacctttaccaattccataacaatctcctcatttaaccaacaagactactataccatagtcttgtcagcttgtaaactaaaattttaattcatttgccaaagcatctaactgagctcgagcggattcgtttctttgatagcgattctgttcagcctgaatttgctgtgaacctgctacttcgttcacttcagttggagtagaatcttgttcaatttctacccatttctgatttcctttttgaacacccatcaaaaacttattccatttattcttatcaccgtatcgtgatttgatttgcttaatgagttgttgttcagcagctgctagctcctcggtttcaatgaccgcaagcataaaatcagctgttgctggaagaccggcagattctgcaatatcgctcatgttaacatcagaagaatcccaagcttgtttaccaacctgtgctgcagtccaaagaacagtttcggtttcaacagcaagagcacgtaattcctctgcaatggctttaacagttgtgtaactattttctgagtaaactctaatgcggcaagatttacaaatacccagatagtcgacaataatgattgttggaacaaaattcttcttgagctttaattcgtttaaaagcgatcgaaatgtattagcatctgctccaccagtaggatactgtttaactattaaacgaccgagagtagatttctcgcgccatttttccatttttcctttatactcagcgtaagaaatatgcccgtcatcaatgtcatcaagagaaacatcaagcatattagcatcaatacgcttagcacagacttcttctgccatttccatggaaatgtaaagaacattatgtccgagctgcaaataatctgctgccaatgaacacagacctaatgacttaccgacgttaacaccagccattaaaacgttcagtgttccagtttcagctccacctttagtaattttatttagaattttgagtctaaatggaaccttacgagctttattcatataagatagccaacgtgcttcgtagtcatccatccaatcatgaccaacgtaactatcaaatgaaattgataatgcttggcgcatgatgtcaggaatagcacctacatctggcattttcttatttcgtttttccggaggaagctcagcattagtttgaatttcgattattttagacgtagcattaaacatcgccctttgctgaacatatttttctgtttcttttattaaccaactgtggtcttccggagaatcagccagttttgaaataagtgtttttacaccagaatattctgtttcagtaaatgaactattttctaatgcaacatttaacgcattaatagatggaacgctatgatactcattgacatgagatttaattaatttgaatgtatttttagctggaccactttcaaaatattctgaatccatatatggccaaacttttgaaaaataagcttgatcaaatatgagatgagaaagaataatttctaccacacttactccttaaaagaatttaaattttttctttgaccttttattaaatgcatcttgtagttgcattgtaatacatttttctacatgaggagctaactcagcttttctttcttggtcaagaacagcaaagtccattacaacctttccatcaacccaatccagtttagttacatacactatatgtgtagaaccatcttctagtttaatgacaatctcctggataacattttccatagcagatttaattatcttaagagactcattaaaaagacgttcttttctttcttcttccccctccgaagagggggattcatcgataatttctagatctaaatctaaatcatctttattcattaaattcttccatatcacttaactgttcgaggtcagtttctaaatcagcagctgatttacttttactttctggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttggtatcttttgcacgccaagatttttcttcgcgaatcatctcgccggtttcttcgtcaagaaattcacgagcataccaaccatttttaggttttactacaaatcctaattctagagccatatctaacaatccagaataaggatcgataccaccgtcaaatttaacatcaataaagaatttacttttttctttaacggtacgagatttttctacatttagaacaaattgatacccctgaagatcagaaccatctttaatttgacgtttaccgataatgaatacagtatcagccgaatacattacgcctgtaccgcctgtcatcacggttttactaaacatttcaattgtttcaattgtatggttaaccgcaacgcacggaatatttttaatgctaaagtaaggagtaacaatacggaataatgacttcagtgatttagcacgagtcatatctgccacagatttttcattcaaggcatcttccgtttctttcttggaagccatattaccaattgagtcgatgaatacaataaccttttcaccacgctcaatagcttcaagctggttcaccatatcaattttcagttgttcaactgactgaatcggcgtatgaattactcgttccgggtcaactcccatggatcgcaaataagctggagtaataccaaattcgctatcatagaatagacaaaccgcgtcaggatatttgttcaaatatgccgcaaccatagtcaaagacatatttgatttaaagtgtttagaaggccctgcgaaaatagttaaaccagactgcataccgccatcaatcgcaccagaaatagcaatattaagcattggaatttttgtacggattacatccttttcattaaagaatttagatgtagtcagttcagcagtcattttagaagtggaagatttaatcaaacgggattttaaatctgcaatagacattcattttttccataggcatcattatattttcctcactggttaaagatagagtaattataacacaataaatttaggcattaatcaactgctattggatgaatagcattaaacttatgaaatgcttctgatttttctttacgtgaaacgcacatgcgaagaacctttaatggctcgtcttcttcacccaacgattttcgtttttcgatattagaagttttccaacgagcttgctctggaaactctctattgatttgctcaagcgctctattatgtttagaattactacgaattgaactacacccgccaggagcttgtgcttttccagatacaactagatatttgaacaaggccaaatgcggataaccttgattaattaaattgagaaatgcatacatatcttcgcataaatcaatttttccatacccaatttgttctgtcgtaagttttccgaggtcataccatgtattcgtgaatccatatgaattttcacgataattaccccaagatgaagtaattttaaaaattggtagacgagcatgaccgtgataatacccgcaatccatggcatcttcaacatattgaatcaattcatagaactgttcacgagttaattgattaattttatctacgcgccgtttatcgtctctctttcgtattgaactcatacggatagtagtatcatcgtcaatcatccagattcgttgacctgcatacatatcagtaattgctttacgagtaccggcaattccattaacatcatcaggaatagttacaattttagctctagacccataggcatcataataagctttttcttcgtgttcacgcactataatatgcggttcataatcagtcggaaacatatcaagggcagaaactgccccgacacgttgataacttggaattacgaattgaatcatttccactcacctttatagtcttttttcacaatatgagtttcgccagtattccaccaatgatcaaccaaataaaaatgacgagaatatacatgaagacttccaacattccatataatagaacctgctttatactgacgagttgaatcgcctgcattcaaatcagatactaatttatctaatacgtatttttgccatgcataatcattacggaatccgaagaccacgtcatttgagcgcatgcttactaccgcattgactttcttatcacgaatcaggtactgtactgtattagtacacatgaaatctgacataccatctttattgtagtcaaattgcatggatggacgagtataaatcatgataccacgccgagaatcaggattttgaccaagttcagctaaacacatatcatactgggcatagttatcttctgaccaaatagcccaaccataattcgagttaatttcgcctttagaagatgctacctgctgccaaatctttggtgtttcacctggaatatctttaacaaacaagctcttagatttataccattcaagttcgcgctgaatgtattcatcattaagagcaccaaaaataaacggttcatctgctacaaatgatgcgccaataatttcaatagttttaacaccagttttatcaactacgaaatctttttcttttaatgcagttcccaaataaaaacggatttcttcaactgtcatagagtcattaatcatttaaacctcaattgatgcattcatatttaaattgtaacagtaataaaccccaccctatgataagagttggaatcatagcaggaactgttacgctatagtatatacttattataatcatcaagattaaaagcaacactgttataattttgcttttcattccttctctctgatgataattacctgatttggttgtgcagactttttagtttcacccgcaattgaccaaataaatgtaataaaccaaccaataattgaccagttaaacagtaaagatgtgaaaaagattcctactgtcgattttgacccacgcatcaaagcaataaaccatggaagcatgtatataataatagccaacacacctgaaactaaaaccataaaaattgaacctgccactaaagtttccatattttcctcacttagtcaaattttttacgcatgaattataagaattcactacatactccatcggagcatttttaccagtacgccattggtaattattagcccaattagcccaaagctcggcgcagtagttttcaattttttcttcgcgtgtaattacatccgaattacgatatgcttgagcagattcatctggacgaatagcttcgtcaaaattcgcctgcatttgttcgactgtttgctttggagcttctttataacacttgacattaggattataaaatttgcttgaacagtttacaatttttcctgcatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacagtgctagattcaatcacaggttgagtatcattttcaacactaacaaatggaactgctgctaatgcaactaaacaaactgctaagcatcccataacaattttcattttattctccaaatccgtatcagtagttgatagttgtatagtaccatggaagaacattcttgtaaacagttttgtgaaaattttttagggaattctaaatgtccagaatcatctgtttttcataagtatagatttatattacttgtatgaaaaagggacccggaggtccctagatttattctatcagccaaacaggaagtctaacgaagctttttcttcatagtccataccagccgattcacacatgcccgcaagcggtttaacaaacgatttttggaacaaagttgagtagtcaatccaagacagtacgtcagaacgaatttcttttggaagttctgtacccgacggccaagcaatgcatttgtcaccaaatggatttccttcacgcaatggaagaaccattactttatttccatccaaaattggagctacacctaaaccgctaacagctcgacgataagttagcacaccacgaatatggaacggacatttaaatcctggccaacctttatcatcatatttcgctatatcgttcgcagtttttacttcagcaataactttatagtcaagttgacgatattctttctcgaagttcttgtaatattcttggacagactcttcaccttcctgaagaatacgacgaatactttcttcgagagcttcttggaccgctttaggcgttgaactctgctgagtttccatacccatgatttttagatgtggttcagcaaaacgcttatcttccatatcataaacgttcagagcataacgctttttcgctttccaaaatccaccaacgccctttgaaccaagtggagggcaagaaatagcttcacggtccatatgcatcagatgctcgcggttattcatataatcacataactcacgatatgcaacatcaatcataggttccatctttttcttaccgaactgattcatgaattcaactaaatcgttctgctctttgaatcggtcaagaccaactttttcaataactttatctacacaaacatataccgaatcagtatcacctgctgcaatgaaatcttcgccattagttccgcatactttattcagatattcattaattttacgagcaatccactgaataccgacttggccaaaaattgtgatagcagtagcatttcgcaaatcatagtaacggaaatgaatattaccaagagcaccataaagactgttaatgagaattttacggttcagctgatttgtattagcaagtgtagccgctttttcacattcttcaatcagactattgagaacagattcggtgtaattcgacagttcatttaaaaaatcatcagtgaacttaacatatcgttcaacttctggtttagttgaacaagaccctgcgcctttcataataatctttttaatagcttcggcattcatttcttcagcgaacattttctttttccagtctttacgctggaaaaatactttagcgatttcctttggaatgataccttcttgatgcttatcatacatccatccattcggagaacaagaatattcatcactcggtttaggagctgttcctgcgatatattcatgaattggatgaactttaaactgaccacgaatagtctcaggactaatgttaacctgacgaataatgctcggatacagagacgtcaagtcaaaactcataatatatcgacgagcaattggtttaggttcaaatacaaatgcacccggaaaactctgtttaacgtgcgaaccttgttgaggaataaccttatgttcacctttcaatgagttaaaaataatagcatcccaagttttaataggactcattacaccagaaaaaggcattttagcgtaataagacatacttaaaactagatcgataaacccgcgaattttatcaattgcttgaactgattctacgtcaatgatgttataactaatgtatcgctgatgattagtctcacgaagtttattaataggaccatcgtacggtaatttaccttttttggtttcatgttgagcaactgattccaaagagaatgacggcaaattagtaaaagcgaatttcttgtacaaatctaaataatcaagaatagatacgccatcaatagaataaatttctttgctaccgtacatattttgaattagtttagattttacccgaccgattggagagaaacgtttcatactgcgttcaccgagaaccattttaacacgattcatgatatacggaacgtcaaatccctcaatattccaaccagtaaaaatagcaggtcgtttctgttcccagagattgatatattccatgagcatatcacgctcattatcgaatggcatataaattactcggtcaagaatttcttgaggaacttcatcaccaccttcacagtcaagcttagcagctaactttgcatcccattttgatactgaaccgtacattgaattcaaaaggtcgaaaacataaaaacgatcatcaattgaatcataatgagtgatagcatcaatttcatattcagctttcattggatcaggaaatttatcaccagtaacctcaatgtcacagttagctacacgaacaaattttcggtcataaacaatttctgaaccatacgtatcactgatataagcgagtttaaaatcgttcataccaagagcttcgagaccgatgtcttccattcgcttcatccaatctcgagcatctttcattgatggaaatttttgaggagcgcaatttttaccatagatgtctttgtactttgactcttccttacaatgtctaaacatagttggaagatattctacttcgcgagtacgttcctttccattttcatcaatataacgttcaacaatgttatttccgactgtttcgatagagatataaaattctttcatagatattccttagtttatagcccgagttattaggctcttgatatattatactccaaataaggggccgaagccccttgcttaaattagtactatttgtcgggtgaaaattgtcaatccatctgcattaattgacttaacgactgtagtaaagtgtttttgttctgggtgaactaatttttgaaattctacctgaaattttagttgaaggttttctggtaaatcgaaaagtgtttctgttgcagaaagattatatttttctttaagagacgccatgtattcttgcggagttatagcagtcatattaattaccaatcgtatatttaggaacgagtttccattcatgtttttgtttaaaagaaataactcggaagttattagttaaatctttcataaaagttctttgaccaggaacgatttcaatcagtccccaatcttctaatagccatgcaatcgaatcacgacgaacttcatcttcttctgtcatttcaacctggcgaccatccatacgaagcatttctttaaaatgaacgatatagtatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaaaccttttagttcttttaatactaaaggaagttttccatttttagtaagaattgatttatagttaattgcatcatttgtattaacttgataccgcttagcaagtaacttaataatcaatacttcggtggaatcttcaaccagttttgcccatttaccatatcttttaccacgaggaactgcagccattagataattaaaatgagcttcatcacttaatccagaaccgattaaattcatagcatatacagctggcatgcactctggaaattgtgataatgcattttcaaccatgaattttgaataatctttttgagcaatagagcatttagttttattattaatagctccaattatttcaaaaaattcattttcagctttttctttaaaagaatcagcagcggattggacagctgtccaatcttttgaataccaagcaacttgatgctcgtttaattgaatatcatcttcaaataagctcatatcacttccactgcatttcgcatgctaattgaatgaaaagataagctaaatgcaattcagtattagctgcaataccatgatactgattattttcgcctacaatttcgtacatacgaataatactctgcggagttacacgtgaatagatttcttcggcaagtttaccaacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaacgtaataactcggcagcgtgactgaagtggtttaataataccatcaatattgttagcagtaataataatactacagtttgaactataagcttccataaaggaacgaagatgtcgctgagattctgctaaacctgaacggtcaaattcatcaataacgattactttttgacgaccatcaaatgaagcggcgctggcaaaattagtcaaaggaccacgaacgaaatcaattttacaatctgaaccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctctattaaaaatcatgggtagaatcagcttcaagagctactacataattcgcatgttcaccttcaaatttagcagcgccttgtttaccttttgcccaaagcagaagtttataatttcctggttgcattttcatatttgccatattgataatgaaattaaatgtgttttcaccatcataatcaccaagagtcaaagaatatttaacacgagtcaaagcagaatcttctactttattaaaaccgttaattacgattttaccttcttttactgtgatagcaattgtatcaatctgcagaccgcgagatacacgcaacaactgttgaaggtcttcagctttaatttcggtaacaacagatgctaccgggaatggaattggtttattaggagcaactactgtactcggatcggctgctggccaaaaaattgttgaacgggcatcagcaattttaatatttccatcttctgactgggaaatttctgcatcatcattaactagcgacagaataccgagaaaaccgttcaaatcgtaaattgctacatcaaaatcaataacgtcagaaatatttgcttccgcgtaagttgtaccattaactgcgcgagtcataataaattgaccggatttaagcataatgccagagttaatagtagcgaaatttttaagcagagcagtagtatctttagacagtttcatgtaatttccttcaattcaaatgagatttaattttataactaatttaataaagcaattaacgattaaaatcagccgcaattgtttccgcaacaatttgagcagcaacaattagacgttcatctgcattaccgcaataatcatcttcaagacgttcaccacatgaagtcataataaatttagcaccggcgtttagggattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcatttctattggacattatttttgtatattctgctttaaatgcattcctaagcatagattcagtaactatatgctcttcattagaaaaattatttctcagaatatatcgttttatttcaggaatagttaatagatgctgtccggttgaatattccatgtttttcctccatagagattatactctaataaattaaagcataatctcttataaattaaaccattacagtaaatcgaccaactttcttcatttgaagatgctgaccgtatgcttgcgggtcatggtctctatgtgaaataacaaaaacgttagtattttttaaactatctaaaatagttgaaatagcttttacaccttcaacgtcggtcgctgaatcaaaaacttcgtcaagaattaacgtgtttattttaacacctgaaactttttcagcaatatcacgccaagtaaataaaagagcaatatcaattcgtgctttttcaccttgactgaatgaagcataactaaaatcttcgcgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagccgctttaacctttttagctttatctactgctgcgatcagagattgctttttattgcgaatatcatttgccaacgactgttgggttttaatattatctcggtattcatcaacaagaacttttaaattatcacgatgtgttgaaagctgttcaaacgaatgcgtacattcagaaactttatctttaattttagaaacaactttatcaccggaactcaattgtgacaaacaggttggacataatccaccttcgtgatacatattaatgactttattatacgagtcaatttttgatttaattaaaactgcttcttgaccgattttattaaatgcatcagtcgggtcttcatctaaaacaatattaactaatctttcattagcttcttctatttccgattttagcgttctagcttcttttgccaaatcatcatacatattttgcagacgagtaagattgtcacccgttaattttttctggcgttcaacgttatcattatatattttaatttgttggataatactatcttttttaacgtcaagcacttggttttgtgaatttaattcacgtattagtgctttattaagcttatccatttcagctaatgttcctacctcaagcaggtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcaaaaacgttcggtttttgtcctcttttgatatagtactttttctcatcatattccatccacagttcaactaaaagttctttcttatttgtgctgtttattaattggcctttctttacatcacgaaatggcttgccaaaaagcccaaatgtgatggcttctaacatagtagacttaccaccgccatttcgtccagtaataagagttttttgaaccttatctaattgaatgtcaataggatttccacctactgacattatattttgatacctaactcggtttagtttaaaattcttcacaaaagattccttttaatgtatcttttagaccattctatcatatcatcataatctaaaaagtattcatcaaattcagccatgcaaacaacgccttgtgctgtttttgatgtaatataaattattccaacatatctagaatcttcttcggtataatcaatgtttgctatgaattcatcattaatgtcaaatgtcgaaaacttcacagtatgcatccttaatacaagatacggccatatctcgtaatgatttaggtgtgtcattatctaaaatgttgaagttaaaagatacagcccagtcagtgcagactgtaacctttttaatacaattatcttcaacctctaacggttcaaaccaatattcaataatttctttatgcccaatatcatcttttacttcgcattcaaaatgctgactcatcataacatttttaaattcatcaaaagtcattgtgttgcctctacatatagctgatttgcatattgaataagtgcttcacggtcagaatcagtgatgtctggaattgcattaatatactcttccattaatgtctgaagcgattggacttcaacttcttcactgtcatctgactcgacagagttatcaatctttgacacaactcgtaatgaatgcacaactttttctagttcagattcaaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccgcgagggtcattctcgtcacctgcagttagtgtccatggtgtcccaatatatctgacgttagcagcctcagagatagtatggaagtgaccagaccacacttctttataagtcttaaggaaatcaggttcaagaccatgagatttcattcctttataaaaataaaatccattcagttcccagtgaccaacacaaaaagaagcagatgaagttttgatgtgttcaagaatttcaccagtattttcttcacacatccaaggaattaaatcaatcaaacatccgtcaaaatctactgtagtaggcttatcatatactttaacattaggatatttagccaaaagctcagtagaggcatttggagttaaagtatttttaaagtgcatatcatggtttcctacaacagtatgtagggtaataccagcatcatcaagcatttgaactatttcacgagcgaactccatagttttgtgtgtgattgcttttcgcacatcaaaaatatcaccgtattgaatccaggtagtaattccatttttcttagaatattctattgcttgtttaattccatccaactgaatggattgaacccactcatcatcggctttaacgcctaaatgccaatcacctaaatttaaaattttcatatatcaagaaccgtcattgaaatgcaaaataaaattattgaaataaacccatctggcgtgctaaagaacccaatccaacatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcgcgttcacggtcataaagagttcggtcagatgacagttctttaatacgttcaaatgttgattccatgtcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaactgtttcaggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcgtattcttttgctaataaaaccggaattgaaaatgatttataatcatgcgcacaattacgagtaaatgatttatctttagcataaaccaaagttacttcatgaccatttttaataaaccaatcacgctgctcaagagaaaatttagttacaccgcaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcataactgccaccattttttgacttgataagaatcaacccacactttcatattggggtctgctcttacaataggaggattaacttctttaattgaactatcatggtattctttttcagaaattttcacacaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgtttcagaatatcccgacttttcttgatagcatattcgtattgagcaaaattattgttttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgttggacaaatgcattaaaacaagcttgagttatatacgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaaacagtatgcttggaatactttctccatcatctttttaaattcatgaatatctatgtaatgatcattaatatcagcgcgatataaaaagtctaaaaactttttatgggtattagaatatttacttccagttaattcagaaacatggctttcccaatatccaacaccagttttatttgggaaaaatgaaattttcatgtattggtcaacatagaaaatgccataattttcaatagtaatagaaatattaataaatttcatgcattcatcaacttagccgcttcaagagctgcatctagtgaatcaaattggtcaacatattcaatcaattcgccataattggcatataaccaccattggctaaattcatactcaaggatgaatccgtttccttcaatttgagttaaaccaatgccatttgtatttacttcatacccagcaagacgcaaatcgttaataagagcttcgttcataattataccttagtaattttcaggtctgcaaattttttcttacgttgatttttcatgcgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcaaagaaactactttatcatatgcgtaagaattgatggcgtttttaatttgaatagtcatacattatcctcaattacgttaaaattttattatccaaaaagggccgaagcccttagctaaactttttggcacccttccagccttcgtacatcattgcgactgacaatgacaaagctccttcacatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattaccattttcatcaataaatttaatccagtcatttactgaccacttagttgtatcaccttttggggtaacatttaaaatatatagcccttgcttaaaaagcattcgtttgatattcatattttcctcagctgtaacgatagcactcgtttgatttacgtttagcaactcgttgagaaatattataatcaaaatcatcgtcaatgtaaactgattttttcaactttcttacttcaccacgtaattgacgattcaattcattcttaacctctgaatcaacacctcgcatacgtcgccatttatctgagcgaaaaatgttttcaaccatatctttatgacttacaccatcaggagctttacgctttccgaaatagtcataatcacgcacttttaagtctttacgacgatacgttttacccatggattttaatttccttagcaactgaactaaatgcagcacgatcgcaaatcatgcgtttatgtaacttgagtataatatagcaaacttcaaaactatttacatgagtaacacgaacagcattaccattaatgagataatactgtccctttttaatttctttatcaaccataaccatatcaattcctcaaaggcaattcatatgttaataataccacagtttgagctcgttgtaaacaactttgtgaaaattattttagggaatgataagaagggaacgatagcttagaatggtaatatacagaatgtgagaaagaaggacccagagggcccgtcttagtcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagcggacgatcatactcaatcttaccgttatttgtaagaactttatagaaagtaaaaggagcattgagctcctttagaagttttgtaactgattgacatccaggacaacgacctacttcttcggggatgccatagatttcaatcttattctttaagttcgagttttgttccacgagaaataattccttgataagcccagtatggcgggttaacagaatcctcaccagagttttcttcaggaaaataaacctggataacgaagccggattcatcaaaggtgaaataagtagtaggcagttcacctaacaaatcggcacgagcgttgatttcttcgaggtcttgttcacgtccagcccagaagcttgggttcagactacattcatagaaataatagtcattaccgaacatatcaaaaccattccaactctctactacataccgctcaaaactaatcataattaagcctttttatcaagaacagcattcagcttgttagtaattttatccagacgctcattaaactcactagaagataatcccttttctggagaaattaaactaatcacgaaaaatatagcaataaaaggaataaggaaaatagctccaactgccataaacagaaagaatgttacagttgtaagaaaatcagctaaacctttacgaaatttatacatattttacccttaattaattaaccaagcattgataagcactaaactatattgggaataaaattctggaccaaaatgaaaaatcatatcatttatagtatccataatgtaattcagtttaatcatgtttccacaccccatcggtatttgaccaaagtcgctgattatctgatcctcgccacagctttttagtcggaagatttttctcatacttcccatcaataataacatcaacatatttaagcatttctagctgtttaatatcttcaaacttatatcctgtccacaaccaaatgcttttattgggataaagatttttaatagtttgaaccacagagtgaatcacgtctctgttatcaggataaagagggtctcctccagttatagttaatccttctatataatcattattcaaacattcaattaattgttctagtgtttcaccagtgaatggaacgccatttctagcgttccatgttgatttattataacacccttcacatttatgcaaacaacctgtaacgaaaagaacgaccctgcatccagggccattcacaaaatcgcaaggataaaatctatcataattcattggtgtttaaccctatgcatgatttctttatttttgccgagattaaatccacgttcgttcggatttcccaaataaccacaagttcttcttattgtgttcatctttttaggatcagtttctccacaaatagaacaaacaaacccgttttcagtaggagtcatttcatgggtacttccacacgtaaaacatttatctactggcatgttaacaccaaaataatctaaatgttgtgcagcataatcccagacagcctcaagaccttttaggttatttttcatatcaggaagttcaacataagaaatgtgaccacctgtcgcaatgaaatgatatggcgcttcacgagaaattttttcaaacggagtaatattttcttctactgaaacgtggaaactattagtgtaccagcctttatcggtaacatcttttacacttccatatttttctgtatcaagtttacagaagcgataacaaaggttttcagcaggagtcgaatataaactaaaagcaaatccagttctttcagtccactgtttaagatgagcattcattttagttaaaatttcttgtccaatatcacgaccgacaagaatattcaattcgtgaataccaatgtatcctagggacactgaacttctaccatttttaaataactcaattatatcgtcatcaggtttaagacgaaccccgaatgcaccttcttggtaaagaataggagcaacagtcgctttaactccttttaaggaactaattctacacatcaaggcttcaaaacataaatccattcgctcattgaacaattcagtaaatttctgttcattgaactgtgttccaatataagaatctaatgcgatacgaggaagattcagtgttacaacaccgagattattacgtccatcaagaatttcattaccagtcgaatctttccatacgcccaagaaactacggcagcccatcggagaaacaggaatagatgaaccagtgatagctttattgttcttagctgaaataatatcaggatacatccttttgcttgcacactctagagcaagctgcttaatatcatagttcggatcgtctttataaagattaacaccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggtgtttgcccgtttgaactaaagagagtatttacttcatattcataagcttgaaatgcatcgtatacgtctttttctgttttagattgagcataattcaacgcatcggcgatttgccatttttctgcatcctcaatatgttttgcataggtgcgtttaacataaggagaaagtactttatctacattcgcaaaagtcgttccgccgtattggtgagaagcaacctgtgcagtaatttgtgccataattgcagtagcaacgccaattgatttaggagtttcaatctgtgcattaccaagcttaaatccgttctcaagcattccttttaaatctactaaacagcaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaactgtgttttggtgtcagattcattatattcaaatcctctttgaagcatctcggccatcatttcctcttttcctaaacgagaaaattcctttgatttatctccaacaaagttaggatgaatattattttgggtgtaatcggattttaaataagtaagtaaattttctaaccattcaagataatcaacaccttgtccctttaagccagaacgattaaatttgtgcttcatttgaccttctgcagcattgcagagattacaaagcaatccacgtacctttcctgcttttggtccatttaattcatggtcatgatcaagatgattagcttgaacgtcaggatttagttctcgttggcaaattaagcatttaccattttgtgcatcataaaatttttgtttttcttctttgtataatttgccagtcaataacataataaatacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgtcctgtcagaaaaagaattttgagttttttcaagtattgtaaaacatttgatgcaatcgcttatattgccgaatcttttggtcagaaaaagaaatttgagtttcaagccattcaatgtactctgcggcagcttgcatcaggttaccttcatagccatcgttattttcttgcgcagctaatttagctaatgcatatgaaatacgttcaccttgaaaagcggctttaggcttctgaacatcttggctagttctctctacaacttcctcgatttcaccattttcaacggattcagtattccacaaacaccaatacgtaattggcttatcatagatgttaataatttttccatcagaaagttcaatttcaataattccagtatcaggttctatatcatcttcgcattcttttgcaagttcacgaactttaaagacagtacctgcactaagttccggccagtaattacatagccctgtatcaacacgattaattctaaaccacttatctactgtaatcatgtcccatctccatatcaattaagtcatttatcgttggttcattatatactgtttcttcatcagtgtaaaccggttcttccggctctggctctacagtttcccatctagccgcccaccaaggtttaaccccgaagcttattaagttcttcataatcaatccaggattctaatcctgatggcaaatcagattcaatttcccaaagaagctcttcaattttctgaagacgatctagttcttcggctggaatagtaaccattgacggagttcttgatacattaatatcgtaaatcatatttaccccaatttaaccatacaatcgccgtatttccacttagaaatagacttttcaccattagaataataaacttcgagtttagcacgattatttttaatttgaataaccttggctgtcatcaaagttccatacccataataaactgcaacttcatcacctacatataccgcgcttccgcggtaatcatgaatatagtcagttccttcgagcatcatttaaaatattctcgcagttggtcaaagccgccaatatgacttccatcaggagcaaatacctgaggcattgtcaagccaatttgagtatcacgacctagtttagtcagaagctcagcaattttctcatcgtcaaaaacacctttttccggcataatgttgataaactcaaacggctgtttcttcacggtcaaaagacgttttgcattatcgcaatacacacatttatggatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccatgttcattataataagctattgctaattcacggactgccttttcagcagtctccatatattctttacgctttgtcattttcttctcggtcaaatcggtgtttacaatggcgacatttataacgaagaatactagtctgccaatgaatcaattgaacctgttcagttccacattcagggcaattaggaacgtttttagaagccctttcacgacgttcaaccatgaccattacagaatcccaattaacaggagggctataatcatcacaaccataaatctttccacgcatttccatatcatcttcctcaccagccataataattttaattagactagaattacttgaagctgcaatgtcttctaatagacgctttttcatttcaatacctcaatagcattgcgtaaaccatttgcttttgcattaagagcttttaacaatttggtgtgttctgcaatttgggcttcaacttcaatcaaacgagcattgagatattcgcgttcttcgctcaagttatcaaccttttctactttaggctcttttacaactgtcttatatgtattagggttcttcagtttaattagaatgcgtgaactgtataacattgaaccattatcttcggtttcgtcatacatttccactacgtccatcatctccaccatcgtgcagagtttataagacaacgaacgaataattttgttgtgcttattaatttctctagctgtcatggtgccgagattacgtgagtaataataaggaacctggatattaattaatactgatgaaccacctggcttgtgtgttacttcatcagcaataacccaatccttaacatgaactgtatttgtacggtcatcgcccgcggtaaatagtttacgagcatgcttaaaaagcatattcacttggtcattgaattgacaagcgaatttatcagcaaatttagtttcgggaatggtagataaccaatcagccaaatgggtctttttaacatcgttaacaatagtaaattcaaccaaatcggttatagatgtcgcagttttaatgaatctcggcttcataaagtttttaatgttatcgcgagctacagtagaagataacatacgagaacgtttaaaccattcaagtaaattgcctaacgaatgagaataagcgttctgagtatctttacagatatgattttcctggccaacatactgaaggaaatcacgaagaatattattgattactgctctgtgtcctatctgataatcacgatgtttagtaataagactgtcaaaataatcaatataatgtttacgagttttcatattcttctcacttggttaatggtttatactccgagccatccttggctttaaattacttaattaactgtaaagcttgttcaagacgatcaagacgattaacagattcttcccaaatccttttagcctgctcatattctttctgcgctttattagaaatttctagaacttctttataagctttttctagtgcaataacttctggacgaatttctatcggttcaggtgaatcatcaagacattccattagttcctcaagggtagtttcttctttaggagtattcacaatttcatcacatttttgttggtaaatttctttatcagtaggtgaataagcacatttcacttcacgaaggctaattacgagtttatatccttcccaaccgcatatattcttaaaaggatatgtatgaatattttctactgtttccatacaaagtaatgcggtctctaattgacgagttatagtgctagcaattgagaaaaatttattaatattcttttggttagtttctggtgtaaaaaatccataattcacaaaaatagatactttatttttatcaagttcatattcttttatgataatcatatcagaagccaaaggatgaatttgacgataatcgccataacataatttagaagctgattttagaatctgtcctttgaaaagtctaaaattactaatccaacgacgagtaaaaatattctcagggtcttctttattattaagatgataagaattaacatcaccgaaccaattatatcctactacatctttggttcgtttaatttctttcccaaaattaccaagaatatcccgattaaccaaatatgaaagaagacgagactctttaaaggttttcttgataacatctttatctacacggctagaaattttacgaatttcatgaataaatttagtagaagaaacaatacttgcatcaacactattgagccattgattgataatagaaagaacgctattttggccaaacatcggtatagctttatcatcaataacgctattgaatgatttgatatattcgttacgagtcataataatctcctcagtagaaagtaagaacattataccacatccttgtggcaaagtaaactagttcagtgcatttagtgcattgttcaatttagaacgttgcttcgtgagatttttgactttttcttgagctttttctagcatcttttcagcttctagcacttcattagttgctttaacgagttcatcatctactgccttgatagacttctcaatcgcatccgcgtgccatttttcaacaggtttaagactcggattttcaataggaagaaaattcactttattgaatttccatgcatctttattacctgagctatacatccaaaatttaggatcgtttgatgagcaattagataaatttaagttatcttgcacttcctgctttttctcttgcgggacttcatcctttctcaaaaaatcgtatttaaatgaaacgatcatatcaagttcatacgttgttgtatgttcccaatttcgctcaaaatgaggtaaaatcttagactgaacagcggcaacaacatccatatacttaaatgcttctgtcagctgtgatttaagacattcacaaattgaaagagaatttttagtattaggcttaaagctaattcgtgcagttctattattttcttttaacggtcttacttccatctgaagagtataaccatcaaatttcaggttctttaagttaatatcagagccttttaatcgactagcagtagacaaaatttgctttaattgtttacggaatagagcaataaatctccattcaatacgataatgatttggattgaaaaatccagatgataaatcgaccttactttgaccaacgccttgaacaatcaaaggatttttataatcaatagttttacagaaatcggtgagctgttcacgagcagtcatttgcgtaatatatccagctttatcaaaatgtcgcacccattcactgctattcgtatacttaaagtgatgaataacacgattaactttatcagggtctaaattattttcacacaaaaatgtcataacatcacgagtatagctggcattacgaaccatatcttcaatttgagaacgagttttcatggtgttccttaagatttaagtaaatcaacgattttaattaatttttcacgctcagatttagctttactactcaatccagatagtctgaaaatttcatcatcatattgctgaatagaaatatttagctcttcaatctgcttattaaaataagcaatttgttcagaatgtttttcattactgcgaactggtacaggttttgtaggtaatttagttgaactggattcatctgggcgataaattaaaatgcaatttgaaccaatcggacatttagcaccagacacatattctaatgttccggcttcttttaaaacttcaaaagctaaacagagatgatgccccatattaacataatctgtagagcgagctctgatgtaataatcatctccacgagtactaaatttaaagcatttaaggtcttctgtattattggtcttaaaaatcatttgtttatctagacctttagctaatcgagcgcctaatgctaataatcgtcgttgattttcccacaaatccgcaatcatttggtcaaatgataatttcggcattagtcgaccataaaggtcatatcctttattataattgcgaaggatttcactcgcattaatacgagacaacgctccaattttattaagggctttcatgatgcgattagataaacccattccagatccgtttgttcgttgcaaatgtttatctaatccaaacccaatatcaactttaaatttatctaaaatttcagcatgaacatctctgtcaataacattcaaatccaaagttgggttaaatctatgaaaaaatttatctggctctccacgacgaagtacagtccattcatttaattttttattaactaaagatttaattactgcattgacattattaattactactgacatatttttctcactcaattttcaattttactaaatacacagaatatgatggaaaagactatataagcaccgcatacagattgaactaataccattccaaagaaccaaacaatattatcaaacaatgtctgttttacgtcgaaaggacgtaaacttacagtaatattatcgcctttttctattgatgaatacatctctggtgaaatatattcactaaatctataaccgtctttgagttcatatacggcaataaacgataaactagacccctttccttgagttcctgtaagggtattaactacagtaacatcataatctttataatgcatataatcattaattgcataataaccatatgcaactactacacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttgtaagtttcaatacgctctgaaatgagagtgtatcgttcatttactgattctttcataaaatcaggaatttcacgagaagctttaatctcatcaaatttatcaataacagcttgctcttcagcaattaagttatcatacatcaaaatatctttcttgatgaactcaatatcttcttgagttacacgagataacttagatgctttatcctttttgtaatgttcattagtatcacgagaccagtgtaatgtacgatttttattcgtattcttgtaaatttctacaataccaatctcatcaataataacgatccaattccaacgggatttgtaaatttgtcctccatcaaccgtgatttcacctccgattgagatgtcattaaagaacttgctttgtgcttctgatttaaatttaccatcgttgtaatttaccaggttgaaaatatctttagcgttcattttgtgttcctccgtagttgatagttgtatagtaccacagaggaacagtcttgtaaaccactaaaagaaacttctttcacaattttttccactgaaccacacgctcactgctttcttagtctcaggagcagtgttatccataaaccattcaaaggcagcctttttatgattctggagggcttctcgggctttaatctgctcacggtctattaacactaacatatgagcctttcttgtcaccaggggcttcttatgattttttgaatactcccaatcatttgtccatcgcatcgttgttgcgaattgaagtacagcttctttaatcttagtttcgtaaatttcacgagcctttgagtataacatcattacctccatttaccagtttaattctagtcatctttttaatggcagtccatataatctatttctgaactgcctttttgtcttagaagtcctcttatgaatttatttcagaagagtaacctcagcgatttcttcccaaccgtttttgtcggtcataataaagtcagcaagataaagagcagtacgcagtgaaacattacgtaaacggttaacattgactttcatccatgataatgctttataagtttcttcatcagaaagaccgcgcttttgcatcatgtcggttgaaagaataacatcttcaaccctgaccataatttcttcattagtgtgaacacccaaatctaaataaactgagcgggacactaatgcttgtaaatgtggagcaagtttagtaccacggtctaattcgcggtcaatatcaacgtttgtgataaaaacaatcgttcctttaaattcaaactcacgctcaatgcctttttcttctaagtaagaagatgcagtgctccagcagactttacgggtctctccagtgtccagagcagctttcagaagattaagaatgtccatatcagagaaaacatccacatcatcaatcaaaaggacagaattctcttcacgattattccagagctgttcataaagaccgataccagagattttaccgttaatgcttttatattcaatgtatccaatatcatttgctttatttaaagctttatctaaagaatacgttttaccaatacctgctgctcccgagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgtttaccgtcaatttcaacaaaaactttaccatctccttgtgcatctaccggagcattatctgggaaccattcgcctaagagctcaaaagttccagagatttctttaccgaagtagatacccttattgatagttacagttttcattttattctccaatttcacatttgttttgatagggtaatagtatcacactactaccctactgtaaacaatttattttaatgtttgccaaatttttactgcttcgcgacgagatacttctacagctccaagttctacagctttttggcgtcgccgagcgtgtaagtcataatgtttaatgcgtttatcttgaaaccaagaacgtttcattcctattgcttctgccatttcgtgaagctcttcaatatctccatcagtgaacatatgacaatttttagttggatgaccgcgaagtttccatccatgattcattaaaacatctacgtaaactgtcattgattcttctccaaataagtttcgataattttctgggcaagataaaccgcgttatcttcagttgcgtcttctaagaaactttcaaaacactctgaaatttcttctgtatcaatcaacttttttacttcaattggtgtaattttcattttgttttccgtttaagtgtttgttttgatagttgtatagtaccataaagctttatgcttgtaaacagttttgtgaaaaatttttgaaataaaaaaagggagcccgaaggctccctatcatttataataacttcggtggttttcaagatagaccttctcaaggaagtcatcccaaaaacccatgtccactttttgctgcataccgttcttagaagcttcagtagatgctgcttctacttgatcgaccacatcttccaaaaactcttgaactgttttaaatggatgcttacccaacttcacgtcgagaataaatggagcatctttgagtggatagactaagtcaccagttttgtaaatttccaatagttggagtccaccacgacaagcatgactcaaagctttccagtcaataccttcattggcttcggccttacgggcacgttcaccatattcagcatctaatttgttcagtgactgcttaagctcaataagagaaagcgttgtctgatatttacgacccaacacagtgtagaacgtttgtgggcctgttttctcatgattatggaacacccattcacagaattcgttttctggaagacgatgcttaatatcttcaactttagtacgacgctgcttaatggaaccgtcttcttgataatcaacccattgctcagggatttgattaactactttcaatacatcacgtaatgcagccaaacgagaacccttgacgccgtatttagaagcttgcttgcggacatatcctaaatatgatttcatgttagtcgtataaaaacgagaacggttgtcttgaataaacttccacacatcaggcaaatcagatttaaccactagttcaggtggagtgtgaagcatatctaatgctacagtttcaccatctgctgctaatttaaagaaatatttaagactgtatagttcatggtcaatatcatctttagtgtttttagatgatgtgttgttagtgtttttactcatgtgctctttaacatttccaataagaatatcacgagcaggaggaacaaagatttctttaaaatctacatcagattctggggtagaagttccataaagatgactaccaaaatagcttttcattactgttttcatcattcagccttatattcaataacaggacatactttagctttacgcgcttttaaaaattcgacgataatagatttcttgggttgaataggaggtaaacctttatacgccctatcaatattttctacatgtaaagcataatcctttttccatttataatctttatatttttcatgcagttgtgcaggaataacaaatgaaccaataataagtaaaacaagcaaaatggcaagtataaatgccgatggaagaagagtccataaactatcgaaaataagccatttctgtatgatttctgcacagataatagttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattatcctttcattgaaggtgtaacagttgttaaatacttaatcatagcttcagcttctgattttgataatgaaatttcttcattgttttgacgaatagaaataaaatccggatgacggtcaccaccagcttttaaaacacacatataagtatcagtttcatcttcaatatctgaaatgattgaagcagttccacatgaatgtggtttttgataaatcaatacagcttttcttccaccgtttgactgttcataaacttttaacacatcaaacaaatcgcttcttttatcaatagctaagatgttgttttcatcttcaatattaaatccttcggatacttcataaagtgtcacccataaatcaccaatatcaataacagcgttcacttttccatgactttcaagagcattacaaattttcttaatttcatcataactcattttaataatatcatctccttgaataaggaagatgtcatttttaaattcaacacgaattaaaccacttccacttgaaataaacatatttcctcactttgaaatcatagttggaatgacagaatcgagataagtctttagcgcaatagcttcgtctttggtaaatgtgacaatatgtgatcgaaaatcatcaatttgacgaatagttaagacatcaccatcttcatagcattttgatacgtttaaaacagtttcatcattctgattgcaagcattagtaataatagcattgcaatttttgagccattttaaactatgttttctttcattagaataataaaaatatttaatcttagctataaaactatcccaatggataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgcgtcaaacgatacatgttatttactttttctatagccaattcaccaaaaagcggactaacttctaatactaatcgtttcatattgattctcttcgactcactcacaattacatactcctttgaataatatcaataatgttgttcaccagattataagtaaacattgggtaattatattgaatcattacatacacaacaaacaaaactttcattctcttctccttgacagttgacaagattactataccataaccttgccaacttgtaaaccgttaaatgttgttttcaataaaattctgaagctttgtgtgagcatcaaccatgattttcatttcttctttggcgaaagctgtacctctttcccgagaagaacactcatagtcagaaactgcattagcatattcttcaattagtttcattaaaaacatctgcttttcagttttcattattccacctaatcatttcaagatattggactaacttagctttagatttatccaaatcctttttagctgcttctataccgtcgtatgaatatccttcacaatgctcaactgctaattgatatgaatctatttcaacatcacgtgctaatttaatgattttttcaaactgttcgtgcgttagcatacttaaactctcgtattatgatcgataatttcatcaagaaacatatctaactcttctatagcattatccactttagtttcaaagtctttaatgcctttattcgaaatacccgatgaataccaagcaaagtcaatcagctcttcatctgctttgcgaattgaagccactaattccttaattttatccgcttgcttttcagttttcattattccaccacatatgacagagagaatattgcacacgccatatgcgttgcagcttcatcacacatattataacgtttcttcaaaaattcaacaagttcttcactggtaacttcatccatgtcgacgaaaaaatcaccattaatgatgacgtagatatttccttcttgattgagtgcttcaattttcatgatgttctcctctttatccgatagttgtatagtatcacagctcaaatggaaagtaaaccggtaaaatgaaaaagtctcccgaaggagactaatgttattcgagggaaagaagatacttactctggtaaaacattccagtaatatcatctatcgtgctttgaatggctggaggcatttctttataaatgctgttagattggtctagtatgcgatcaatcattttaattgtgtcggtaggaagtttactggcatctggaattgaaggcgtgtattttctaccagaataccccaaatattgctcaccaaatttatcaatcaaatctgacaactcggagaaaataaaatcgtatgctttgtgtctagcataacttttagtttcaaaatgtgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttgttttcaaaaagcatataaacgtgtttaataccagattccataaatttatcaaaatgaggatcgacattcgcttcaattggtggagataaagcaaatgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcattccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcgcgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcatattcacataagctattaattcgttttctttcttatcaaaccgatcagcaaattcttcttgctgatcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatactgtaactcaaaactattcatttcggtttaccttctttaacgaaatctggataaggataaaatcccgaataaaatccttcacctttatgattgatgcatcctttattagaacaatagcaccaataatcgaaatcacaagccatttcatcgttgcataaagcaaaaacaactggccatttacacttttcacaatgggcatttttaagaatactagtttggctcataaccatgtaacctttaagcagtattcttctacatgctgtttacgacctttcttatcaataaaggtatattcaacgaatgttccaatgtagtctttatctacatcatgcggactattaattggacatttagtacggcaaatgcgttcccattgacgaataattactgccttattctttgggtcatatggatgtggataatgtatattcataataacggttcccaatcaacaatcacaatttctaatttagaggaatatgtatctaaaatcccctcaataatatcccagttccctttacctatgcctgcaccaatcctaggcatatagattgtaggtttaatcagtttattttcaccaaactcatttaattctaacatacaattcattaaagcggaatactcaaaatttggccctggttgaaattgagtataaaggttgaagcaatacgctttatgagtcctaaagtatttttcatagactgagtaagaaccgagtttagttacatcaccccattcagtctgtaatttatcagcttccaaaattttagggaaagctttggttaattgacccgctacgcctgaacccatagtatgaaaacaattgcatccatgcgcaatatttttaccttcagcgaaaagggcgacaatatcgcccttgatatattttacaatcatctagtactcaatcctcgattataagaatctaccaaacggtcaaccattgaatgacaagcggctttatctttctcctccgcaactgaacattctaaggtattccactttttagcatatcgttttaataatgtatcgtttttgtatctgcttgatttatctctttctccgtctttatatgcatatattaatttctgcgcaaattcagcttggcatgctttatttttcccacaataatctgccgcagtgcgatttacatattctctaatttcagtatatgatgtatctgctaacgcagaaaatgaaattaatcctatacataaaaccaaaattttagtcatttactatttccaaaagtttattatttttaaggtaattagccttttctaggacttcagaagcatatttagaacctgctttaacattccatcccgaattataagatgatattgcttttcttatatcgcccttatgtatatttaaccaataagaaagttcaatgtacgcccaggaagctgaattggatcgtttattcaacattctttttatttcagcatcggtcatattataaccaagttccttaactcttgctcgcatagtaggcaaataattttggaacattccataagcgtgatgctttggtttagattttaaattaactccgccagagctttcttgccataaaatagcagccattatatgacctaatccgctcttgtggatatttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctgcattgaagtgacgggtttttgaacttctcattaggcttacaaaccgtaaatccaagccaaagatttccatctgtgatttctaaacgtccaggacgatattcaaccccatcaataaaatcctcgtcaatgtcaggacgcggaggcatactcaggaattcattaacttctaaaacatggtcttttattttatggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaaatgacgacgaagcttatttcgacggataaaaacttctgtattgatagtcatgttgttctcctcttaactgatagaaaaattataccacagtcaagaggaaaagtaaacagttattctttaaatctaatcaatttattcatagactttgaaacttctgcacgaacctcatgtagatttttgagctgttcaagacgctgcgtatagtaagcaatttcatcttcttcgagacagtcctgtgaatcttctttaagataccgtgcatagtcctggaaagctttacggactacttcctggaagtcatcaagactttgaattttcttaggagcaacagatacacgacgaggggcagtataatactcataaccaaaccctgcgcttaattgagccattagtatttttcctctggttggaacacagcacgacaagcccacatactggcttctttgagtttcgttttagcaatagctaactgatcgaggctttcagcataattcttcgcgagttcaaagtcttcgcaattatctagtgcttcccagaattcatcatataaagcatcaaagataagccctaaacgaacttcagcatctttgatagcattcactttactgattttatcgtcagtatgtggtttataacctttaatgtcttcaatcatattttacttcctcacctgttcccaaatcatattcaactaaacgaataggttcatgaatgccatatccctgaacagaaatttctgtcgtaggataaattccactaatatcacccatattccacgcttcattaaattgatgttcgcctgaattactaaaccattctgcgaaagcatttaacacatctttagaaccttcaataattatctttgccattacaagctctcagtaaaggtacgagcgataacgtcgcgctgctgttccggagtcagagagttaaagcgaactgcataaccggatacacggatggtcagctgcggatatttttccggatgcttaactgcatcttccagcgtttcacgacgcagaacgttaacgttcaggtgttgaccaccttcaattttaactgtaggctgtgtctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattagaaaataattttatccaagattgttctttaattaaaaatggctcagaatcatatgccattaaactttgagtaattaatcctttaaatggtccatcaataaattccatggtaaaatatggaattttattcattaatcttgcattaggagcagtgcacaaaactctgcatcctttgaatacacctttttgtaatttgtattgcttgggataaaattcgctcaagacgttgttatttgccaaaatttcaaaatgattcaccaatttatttttaatagtttttggcgaaaaataaagatattcgaaaagttgcgtatctgtcatcattgcattccaattacgaaaaactgcggacgagtaataccgccaatgcagcatttactattgcagcagtgttgcacagtttcaatatgaatatcgtaaatcttatccatatcaggagatttgacaggctcatcaattatatacaaaattcgcgaaagcgataaacctctgaacttgcttcctttattaccaataaaactgcgcacagaatcagtaaataaacgaaaacgtatatcatcattagaataacgcgaaaattcctttttaatattatctgcggaaattttagcgtaagctgaagtattagaaagaacaataactgttccaccgtcatacaaccaattagcggcaaaattagttactgcagttgatttaccagattgacgtccaccgtctagtcgaagtgtgcaatactgtttaagtaagtcttcaaatggcgggatatattcgtttttacaaatttcttctactctagcatcagaatggtgtgtaaaagcattcatcagggatagataaggaccagttaaaaatgttctcattttgttctctctaggtttgggccattccatggcgcatgaattgtccatttctgtatttacccattaccgcacttgggctcgaccttattacaggttggcgggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaggtgtctgattataccatctacttttagctaagttaactgctgcttcatcccagcgtttttgttgaagcatacgcaaagagttagtgaatccagctacgccagtttctcccatttggaaaaccatattaattaatgcacagcgacgaacagcatcaagagaatcataaactggttttaatttagcatttctcaaaattccacgaacagcagcatcaacatcctgattaaagagtttttcagcctcatcttttgtaattacaccattgcaattacgcccaatagctttatctaattcagatttagcaacacttaatgatggacttttagtaagcaaatgaccaatgccaatagtgtaatagccttctgtatctttatagattttaagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaagtcttctagaaggtctggattataatcgataaaaccagtctcttctgagcattctctttttgcagcttccagtgcattcaaatcagaactttctacgcggccctttggaatatcccagcgatgtgccatcattccaggcttacgagaaccagtaacccgacccataaataaatctttatcttctgtcataaagataataccagctgatagtgttttcattttaatttcctgcattcagtgataaagttatttaaattttgagtatatttcttttcatcaaaaatcttttgttgtctgcgtaaacgccatggcatttcaatgaacatacgccatattcctgataatactgctgctgtaaaaatattaacaagtatagttaaaagaacccaatctcctattctgtccattggattttttataaaaaagtaaaatacgaacgatgatataggaagactaatgatataccacagaagaaccttcttatctgtgaaccaatcagcattcgttaacttagcgcgaccgttttgaatacatacgaacttatcatctgttacagtaaatggcttagctgcttgatatcccattctaaactccctaatcaacaaatttttcatatcttcggaacaaccattccagtcaactctatcaactgaaatgccatcatccccatcatctaaatcataccagcgagtttttaaaatcatttaattttcctacaatcactcacaaactctttcattgactcattttcaatataagacatgtagctattatattcttttaattgtattttgtaatccttttttctttgccaatttattttaaaattatcataatgaaaatataacatggtaccaaagaatgaaaataatgaaatcgctatagtaaaacgaagttcactccaaacctctgttataattactgtgccgtcgatatttaaaataaaacagtcaattaacaatccaataagactacccgcaagagctgtaaatactgatacagcaagaattaatagtgcctcaggaaacgaatatttgactttatttagttttggcttttgcatcgtgattccttaacaaatttcataatttcatcaaattcatacatatctagcttaagctggtgttcctttttaatctttttacactgagctttccaatcacgtacacgtttacgataatgtcttccttgataccagtatcctacccaatttacgggtactaataaaagtggaactattaatggaagaattagcattaacacaagtatttcgccagaatcaatatcagtcataacatctaaaacacctccaataatcaatagaattacaaatgatatgagtataacaggacctattaacacatcagtagaaattatctgacgctttggttcatacttcacaggtttacttggaaggtatagtgatggttttgacatattctctacattccttaacaaatttttctagtaataaatcactttcaaaattgggattttctacaaatttatcaaaaagatcatcaacaatagttaagatattctttttactaagaatacgtttattttcatgcttcgtttcagaatcaactataagagtaaagaaatatttcttgccctgaaattttacagtagtatcaatataaaataaatttgacttttgtaaattacgtttaaaccatgcgtcacttaaactataaacaccgagataatcaaaatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatgcgtttaagagcatttagtaattggtctggaacatcaacctgtctttggaactcttcaaacattgaattgaaatcactttgcattttcattttcattcctatttactccaagtataaggggccgaagccccttatcattatttcagagaattaatgtattcctgaacatcggcagaggtagtttcaaccccagaaatattaccgttaaaggtttcaactcgagcaagggtatcttcaatatcaaccttagtcagtgctgcaatttcaactacatcatcagcagtactaattccaagggcattcgctgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccatgagagtattatactccggatagtttgtaaactatttcaacatcgccttttgctgctttataaccttcagcccaagatacaaccgagtttttatccgaagattcaaattctggcattgggctttcgccaatgttcacgcagtatgtttcttcattttcgtcgaaccaaataattaaagtagtcatttatttctccgttttctgtatttgttttgataagtctataataacaccgtccttggcgtttgtacacaattatttcatattattgaaatattcttctgcgatttcatcgttatcatggtaaactttagaagacagtttaacataaccttcagcagtgaacatgttaatcacaacctttacagtataccactgaccatcttcattacccattactgcataggtttcaaacatcggatggtcaggaccgataactttaatatcattcactgtacgaccgaaatcttctgaaacacatttcataaagaagttgaacagttcgccgtaattatccatttcattctccaagttgtttttgtatcagtagttgatagttgtatagtaccatggaagaacagggatgtaaacagttttgtgaaaaaattttttaaaaagttttagggaattctagggcagggaggggcaattaaaagataggataatatattataaagggtagaaactaaatgatgtctagagaggcccggaaaggcctagataccaaaaagccccaaccttttggtcggggctaagaatgttatttgatttgtttagcagaccaaatgcggtctttaataattttttggatgtcttcaacatactcaagagagtgaacatgtgggttatctttgaaactataagcacgagctagcttttggccttcagttttgattactaaaagctctttaaggatagcttcatatttggagataattcctttaacaatatttttctcttgtgtgactttaggatctgctttaggagcaggtttacctgaagcctttgcaaaagcagctccagtagcaactaaacttttccaagccatactaactgcattccctgtaaatccttcggctttcatatcacgagcaaattggaatcgtgattcatcggaagcatctttataggaatatttacccgcggcaatggcagcttttgcaacagcttgaatttcagtgctagatgcttcatttaacaccgcttcatttaaaaattgagtatatgatttcatcttatttcctgttttaattcggggttttaatatacttatttatactaaaaagccccaacctttcggtcggggctaagccttgcggcaaccttgtcggggttccacctgctaaggcaagtgtttgtacgaaacgccgggattcgaacccggttattaagcagttgacgctactcaatatttttaaaaggccatatctcgaccatatccgaacgttccgtcaaaaacgctactcggcttacggcaaagatatttcctcgaatcgataattcggtgcgccgtttctgctgtgatataaggggacattaacaaaacataaagatttattaataccagtccttaaacagggaacatcagtccgacgacttgccggtagcgacccggcttcttgtctggtcgaggcagtagggatcgaacctacgacccaggacttagaaggtccttgctcttccttctgagctatgcctcgtatttggcggacgtgataggattcgaacctataaccaatcgcttaacaggcgatcgctctgccattgagctacacatccaaattgatggggagtggtggagtcgaaccacccgagtcgcaatgacaatgaatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccgtggcaggatttgaacctacgacattctgctcccaaagcagacgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttggccattctcgcgctgggaataaaggactcgaacctttgcatcctggaatcaaaatccagtgccttaccaacttggctaattcccaattattaacaaaggctcttaagcaagaacccttgatgatagagggtattaatcagtgcgatatgagttaataataacaaataattcttaaagcatatttaccatttataataatacatatttacgatgcattcaagacccaaaggattcttgaaaatatcatattcaagaggacctttttctgtttcaataaagaaatcaaaatttactgtattaaatttacgttcttccttcactaatttaacttgagaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaaaacattttctgccgtagtcaataatccgcatataaatccaacaaacattgaaaaactgaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagagccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttgtagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactctcgaataacatatggtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgtccttcgtcatcaaaaacaaacacacctttaattgggcttttaccattaagatagcaaaatgcttgttccataatcgtgattacttctaatttagttagatttaaattagtctcacgatcatagtcaattccttcaaactctttacgagttaagcaaggatagtcggtatttgctgcaaatactccccatgcataagccaatgcatccttaataggaccagcaagttggtatttaactgcagaataattgctcatgataaaatcagcagtagtatcttttccactacgctttacaccgcttaaaaagattagtttcatatgtttctcctcaaatttagttaagattataacacatgaaactgaagcattaaacttccgctataatttttccatctttttctacttgaaaatacgtataaggaatcgttgctgtacatactaaagccgggtctgaatcttctgtgtagctaaattctacttcagataggtcagaaacccaaggcttataaaaatttattgacatcacgatttcagttttgctattatctaaaatgtaaagcgtaatgtattcaggacctgttttttgggcagtattttcacctgtaagatagttgctagttcctagcatccattcatacattcctatccatgacttaagttcttcatcaactataaatctcacgatgagtggatcgtactcaaatgtagcacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataactgttggtggtataatgggtctaagtcccttccattcaattccatttagaacaaacaacagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccaggtatatatgccttaatcatttggtctgcacccctaaatcctttcacttgactccaatcaatttttaatttcgttttattagtaatagtaggtgtatttgaatattgctttaaaagctcttctagaaattgctgacgagctttaggtggaatatagtgcaagtttaatccgtacattaaattatgtttacctaaaccaagataaattatcaaaggaaatttatcccagtaaggaagagtttccttgtgtttagcatcataagcaaaagcatatattcgtcccggctgcgggcgaacaaccttatgtccttttacttgcttaatagtttcagcaaaccactttctggttttattattaattgctgcaccttcattacgaattttatcgcgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgattcctctttcttcagcaaattgctttcctgtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgtcagaattctaaattttattccacgcttttcagctaaagcttgcgctgctttccatttgtcggtattaacagaatatgtataaatttcattcataaatcttttcttcgctgcggttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgaaatgcttcgccgtgatgaaggattaagattaaaagtttattgggataccgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagctggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgaccctgctgaccctcctattccaaatgactcgagaattttattcaaagaaccagtttcttcatataaaggcgaatatccttatgtgcatacaatggaaactgaaagcggacatatccaagaatttgatgatacccctgggcaagaacgatatagattagttcatccaactggaacttatgaagaagtatcaccgtcaggaagaagaacaagaaaaactgttgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacggttgaaggtaatggaactatcctagttaaaggtaatgttactattgtagttgaaggtaatgctgacatcacagttaaaggagatgctaccactttagttgaaggtaatcaaactaatacagtaaatggaaatctttcttggaaagttgctgggacagttgattgggacgttggtggtgattggacagaaaaaatggcatctatgagttctatttcatccggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatatggaacatatgaatctgtgtttggatttggaaatgacgcgttgaaatatcgtttaggcgatgaatttaaaactgctgcttcatgggaagaacttcctactgattctgatactcagttgtatttgtggaaagctcctcagaacctccagaagacattcacttacgaagtaacattaatatatgactaccaagaacaaagtgaatctggaggttctggcagtaattctaggtcatcctctgatactactgaaccgacggatcctcctgctccagtaagaaaaactctagttaaaaattacacaaaaactatagttggaaattggagtcgttgggctaataaattaagaagctatgtatatgagaggtcataaatgtcaggattgagttatgataagtgtgttactgctggccatgaagcgtggcctccaacagttgtgaatgctacgcaaagtaaagtattcactggaggaattgctgttctagtagcaggcgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacatttgctgaaataaaacaaaacctcattgaatggcttaatggccaaaatgaatttttggattatgattttgaaggctcaagattaaacgttctgtgtgaccttttagcttataatacattgtacattcaacagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattactattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatacgttgatggagcagaatggattaactggacaagaaagtcaatggttcatgctggttctacatcgacaatttactacatgcgtgaaactattgatggaaatactgaattctattttggtgaaggtgaaatttctgttaatgcttctgaaggagctttgaccgctaattatatcggaggtcttaaacctactcagaactctacgattgttattgagtacatcagtactaatggtgctgacgcgaacggagcagtcggattttcatacgcagatacattaacaaatataactgtcatcaatattaatgaaaatccaaacgatgacccagattttgttggggcagatggcggcggtgatccagaagatattgagcgtatccgcgaattgggtactattaaacgcgaaacccagcaacgctgcgtaactgcgactgactatgatacattcgtttcagagagatttggttctattattcaagcagttcagactttcactgattctactaaacctggttatgcatttattgctgctaaacctaaatcaggtctgtatttaactactgtacagcgtgaagatattaaaaattatctcaaagactataatttagctcctattacgccatcaattatttctcctaattatctttttattaagactaatttaaaagtcacatatgctttaaataagctgcaagaatccgaacagtggctcgaaggtcaaataattgataaaattgatcgttattataccgaagacgtagaaatttttaattcatctttcgctaaatctaagatgttgacatatgtagatgatgcagatcattctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgacgttcgcatagtatcaacagaccgagattctaaaggaattggtaaagttattattggtccatttgcttctggcgatgttacagaaaatgaaaacattcagccatatacaggcaacgattttaacaaattagcaaattctgatggacgcgacaaatactatgttatcggtgaaataaattatccagctgatgtgatttattggaatatcgctaaaattaatttaacatctgaaaaatttgaagttcagaccatcgaattatattctgacccaaccgatgatgttatctttactcgcgacggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaaaacgaactcgggggaaaatctcccgagtaatcaatacagatggattaacttaggatatactgcaaataacagcttcttttttgatgatgctgacccattgacatcatacattatcagagtagctacagctgcgcaagattttgagcagtctgattggatttataccgaagagtttgaaacttttgctacaaatgcttatacatttcaaaacatgattgaaatgcaattagccaataaattcattcaggaaaaatttactcttaataattctgattatgttaattttaacaatgacactataatggctgcattgatgaatgaatcatttcaattcagcccatcgtatgttgatgtttcatcaataagtaattttattattggtgaaaatgagtatcatgaaatacaaggttctattcagcaagtatgtaaggatattaaccgagtttatttgatggaatcagaaggaattctatatctttttgagcgctatcaacctgtagttaaagtatccaatgataaaggacaaacctggaaagccgtaaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagcaatgcacctatagattctgatccattatctccaacatattcggaaaggctatttgaatctgatacaatgactataactggaaatcctaaagcagtatgctataaaatggattctattggtgataaagtttttgctcttattatcggtgaagttgaaacattaaatgctaatcctagaacgtcaaaaataattgattctactgataaaggaatatatgttttaaatcatgacacaaaaacgtggaaaagagtttttggcaacactgaagaagaaagaagacgtattcaacctgggtatgcgaatatgtcaactgatggtaaattagtttctctatcttcgagtaattttaaatttttaaatgataacgttgttaatgaccctgaaactgtagcaaaatatcagttaatcggtgccgttaaatatgaatttcctcgtgaatggttagctgataagcattatcatatgatggcatttatagcagatgaaaagtctgattgggaaacttttacgcctcagccaatgaaatactacgcagaaccgttctttaattggtctaaaaaatctaacacacgctgttggataaacaactctaatagagctgtagtagtttatgctgatttaaaatacactaaagttatagaaaatattccggaaacatcaccagatagattagttcatgaatactgggatgatggtgattgtacgatagtaatgccaaatgttaaattcacgggatttaaaaaatatgcgtctgggatgcttttttataaatcttctggtgaaataatttcttattatgattttaactatcgtgtgagagatacagtagaaattatttggaagccgactggagtatttttaaaagcatttttacaaaaccaagagcatgagactccttggtcgccagaagaagagcatggattagctgaccctgatttaagaccattaattggcacaatgatgcctgattcttatttgttgcaggattcgaattttgaggcattttgtgaagcatatattcaatatctttctgacggatacggaactcagtataataatttacgaaatttaattcgtaatcagtatccacgagaagagcatgcgtgggaatatttgtggtcagagatatataaaagaaacatttatttaaatgctgacaaacgtgatgctgttgcaagattttttgaatcacgtagttatgatttttattctactaaaggaattgaagcatcatacaaatttctttttaaagttctttataatgaagaagttgaaattgaaattgaatctggagctggtactgaatatgatataatcgttcaatctgattctttgactgaggatttagtaggacaaacgatttatacagctacaggaagatgtaatgttacttatatagaaagaagttattctaatggtaaattgcaatggaccgtgactatacataatcttttggggcgtttaatagcagggcaagaagttaaagcagaaagacttcctagttttgaaggcgaaattattcgtggggttaaaggaaaggatttgcttcaaaataatatagactatattaatagaagtcgatcatattatgtaatgaaaattaaatccaatttaccttcttctcgttggaaatctgacgttattcgttttgttcatccagtaggatttggatttatagcaatcacgcttttaactatgtttattaatgtcggtttaactcttaaacacacagagacaataattaataaatataaaaactacaaatgggattctggattgcctactgaatatgctgatagagtagctaaattaactccaactggcgaaattgaacatgattcagtaacaggagaagcaatttatgaacctggcccaatggctggtgtaaaatatcctcttcctgatgactataatgctgaaaataataattcaatatttcaaggtcaattgccttctgaacgacgcaagttaatgagtcctctatttgacgcatctggaacaacatttgcacagtttagggatttagttaataaacgtctaaaagataatataggaaatccaagagaccctgaaaatccaacacaggttaaaatagatgaatgattcaagtgttatctatcgtgcgatagttacttcaaaatttagaacagaaaaaatgttgaatttttataattcaattggaagtggtccggataaaaacactatctttatcacatttggaagatcagaaccgtggtcatcaaatgaaaatgaggtgggctttgccccaccttatccaaccgattctgtattaggcgtaactgacatgtggacgcatatgatgggaacagtaaaagttcttccatcaatgcttgatgctgttattcctcgcagagattggggagatactagatatccggatccatacacatttagaattaacgatattgtagtgtgtaactcagctccttacaacgctactgaatcaggcgcaggctggttagtatatcgttgtttagatgttcctgataccggaatgtgttcaatagcatctttaactaataaggatgaatgcctcaaattaggcggaaaatggactccttctgttaggtcaatgactcctcctgaaggtcgaggagatgcggaaggaacaatcgaacctggagacggatatgtttgggaatatctttttgagattccgcccgatgtatctataaatagatgcacaaatgaatatatcgtagttccttggcctgaggaattaaaagaagatccaactagatgggggtatgaagataatctcacttggcaacaagatgattttggattaatttaccgggttaaggcaaatactatccgttttaaagcatatttagattcagtttactttcctgatgctgcattgccaggaaataaaggatttagacaaatatcaataatcacaaatcctcttgaagctaaagctcatccaaatgacccaaatgttaaagctgaaaaggattattatgatccagaagatttaatgaggcattcgggcgaaatgatttatatggaaaataggccacctattatcatggcaatggatcagacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcagcgtaaaatggcagtagcaaatggcactggagcagatggtcaaattatccatgctactggatattatcaaaagcactctatcgcggagtacgcaactccagtgaaagttggcactagacatgatattgatacctctactgtaggtgttaaagttattattgaaagaggagaacttggcgattgtgttgaattcattaactctaatggatcaatatcagttactaatcctttaacgattcaggctattgattcaattaaaggcgtttcaggtaatttagtagtaactagtccatatagtaaagttactttacgttgtatttcatctgataattctacgtcggtttggaattattctattgaaagtatgtttggtcaaaaggaatcaccggccgaaggtacatggaatatttctacatctgggtcagttgacattccattgtttcatcgtactgaatataacatggctaaattgttagttacatgccaatcagtagatggaagaaaaattaaaacggcagaaataaatattcttgtagatactgttaattcagcggtcatttcttctgaatatgctgtcatgcgggttggaaatgaaacagaagaagacgaaatcgctaatattgcatttagtattaaagaaaattatgtaacggcaactataagttcttcaactgtcggtatgagagcagcagttaaagttatcgctacgcagaaaatcggggtggctcaataatgaaacaaaatattaatatcggtaatgttgttgatgatggtaccggtgactacctgcgtaaaggtggtataaaaataaatgaaaactttgatgaactttattatgaacttggcgatggagatgttccatattcagccggtgcctggaaaacttataatgcttcatccggtcaaacattaaaagctaagtggggaaaatcatacgctattaatacctcttctggaatagtaactttacaacttcctaaaggaactgttaatgattataataaagtaattagagctagggatgtatttgcaacatggaacattaatccagttactttagtagctgcttctggggatacaattaaagggtcgtcatcgtcagttgaaattaatattcaatttagtgatttagagctcgtttattgtgctccaggacgttgggaatatgtcaaaaacaaacaaattgacaaaattattagttcagatattagtaatgtagcacgtaaagaatttttagtcgaagttcaaggacaaacagactttttagatgttttccgcggaactagctataatgttaataacatccgagtaaaacaccgcggtaatgaattatattatggcgatgtatttagtgaaaacagtgactttggatctcctggggaaaatgaaggagaattggttcctcttgatggatttaatattagattaagacagccttgtaatgttggtgacactgttcaaattgaaacatttatggatggtgtatcacaatggagaagttcatatacaagacgccaaataaaagtattagattcaaaattaacgtcaaaaacttctttagaaggaagtatttacgttactgatttatcaacaatgaaatcaattccattctctgcatttggattaattcctggagaacctattaatcctaattctcttgaagttcgttttaatggaattttacaacaacaagctggaacagcaggatatcctctgtttttgtgtgaaggtgctaactcagatacgcaagcaggatgtatatctcttggtggtgaatggaaagaatctaacacagattattctatagaatatgaagatggaaaacctgtcagtcttttatttgatagaaaatttgaatcaggtgatataatcgttataacatggtttaataatgatttaggaactcttttagaaaaagatgacattattgaattaactgatgaccgttatgttagtaaaggatcatctactgaagttactggggatgtagccttaacagattttgataaaatcggttggccaaatgttgaaaaagttgattcttatactagaacgtataattcaatatcatctattttcgatagcatttatcctgtaggttcaatttatgaaaatgctataaacccaaataatccggtgacttatatggggtttggttcgtggaaattatttggtaaaggacaagttttagtaggatggaacgatgatgttacagatccaaactttgcattaaacaataatgatttagattctagcggaaatccttcacacactgccggtggaacagttggaacaacgtcagtaacgcttgaaaatgcaaatcttcctgcgactaaaactgacgaaagagttttaattgaagatgaaaacggatcagttattattggaggttgtcaatatgacccagacgaaactggtcctatatatacaaaatatcgtgaagactatgcaacaacaaactcttcacatactcctcctactaatattagtaatattcaaccgtctattactgtataccgttggataaggattgcataatgagtttacttaataataaagcgggagttatttcccgcttagcggattttcttggttttagaactaagaaaaatgatatttcgattatgaataatcagccagtaggcgctgtaacaatttcacaaatatcaaaaggtttttatgattcaaatgtagaatctgctatcaatgacgttagaaatatggcagagcaaccggttggagctgtattagttaatataagcggcgtatctcctactggcgtgcaacagaccgactattggtcatttgaaggaaccgttactgatacttcagtcaaatcaggtgacccagttattgttaacatgtttggtattccagttaaagctactaatggaatgacttcaattgaatttactagtgccgttagaatagctctacaggaaatggttgtaaaatttattgcaattgattcatttgaagaccatcctaccataggaaataaaatacaagttaagtatttagataaccaagaacatatcttagaacaatactctgataaaggaattactttcaaacaggaaataatttctccttctaaacctgggtatggaacttggcaattattaggtgcgcaaactgttacgctagatagtcacacacaacctacagtattttattattttgagagagtagcatgagtaacaatacatatcagcacgtatcaaatgaatcaaaatatgttaaattcgatcctactggatcgaattttcctggcactgttacgacagtacagtctgcattatcaaaaataagtaatatcggcgtaaatggtattcctgatgcaactatggaagttaaaggaatagcaatgattgcgtcagagcaagaggttttagatggaactaataattctaaaatcgttacaccagctacattagcaacaagattattgtatccaaatgctactgaaactaaatatggtttaacgcgttattcaacaaatgaagaaacattaaaaggctcagataataattcatcaataacaccacaaaaactgaaataccacactgacgatgtgttcaaaaatagatattcgtctgagtcatcaaacggggttattaaaatatcatctacacctgcagctttggctggagttgatgatactactgcgatgactccgctaaaaacccaaaaacttgcaataaaattaatttcgcaaatagctccttcagaagacactgcaacagaatcggtgagaggagtagttcaattatctactgttgcacaaattcgtcaaggaactctccgcgaaggatatgcaatttccccgtatacctttatgaattctgttgcaacacatgaatataagggtgttatacgcctaggaacgcagactgaaattaataataatttgggtggtgttgcagtaacaggtgaaacactaaatggtcgaggagctaccggttctatgcgtggagtagttaaattaacgacgcaagccggtattgcccctgaaggtgatagctctggagcattagcatggaacgcagatgtaattaatactcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggcgattggaataatcctggcgttcctgatatgcggggtcttttcgtcagaggagctggcacaggcggtcatattttaaatcaacgaggacaagatggttatggaaaggatagacttggcgtaggatgtgacggaatgcatgttggtggtgttcaggcacaacaaatgtcataccataaacatgctggtggttggggtgaatataacagaagtgaaggcccatttggcgcgtcagtttatcaaggatatcttggaactagaaaatattccgactgggataatgcttcatacttcactaatgatggatttgaattaggtggaccgagagatgctcatggtacacttaatcgtgaaggattaattggttatgaaactagaccatggaatatatcattaaactatattattaaagttcattactaaggattacaaatgattgaattaaaagagttaccttttgttgatagcgttcctgacgaaggtcaggaacgtatttcatggattaaaaatggtgaagaaatattaggagctagtactaagtatggaaatgatggatcaatgaatagaccaattgtttccgtgtttaaaaacgtcgaagttcttgatgaaaatgtgggaattcttaaaactgccattgaaacatcacagaaagatattaaaacaattcaaggagttttagatgtatcaggagatatagaagcactatcgcagatcagtgttaataaaaatgacatatcaaatttaaagacacttactaatgaacacactgatatattaactggaactaataatacagttgacaaaattattgctgatataggtccatttaatgatgaagaaaactctgtttatagaacaattagaaatgatttattgtggattaaacaagaactagggcaatattctggccaagacattaacggtcttcctgttgttggtaatgctagcacaggaatgaaacatagaataataacaaatagtacattattatcttcacaaggcattcgtttaagtgaattagaaaataaatttactgaatctgacgtaggatcattgacggttgaagttggtaaattacgcgatgaacttggtaataaaccagtagattttggaccaaatatttataatagattaaacactatagatgataaacaaactttaataaattctgatatagcagaaattaaatcttctattggatacccagaaaatgtttctataataacagaaattaataataacaaaagtagcattgaagctattaataatgaattaaatcagagtgaaggtgttaaacaacgcttaacggctattgaaacttctataggttcagatgatattccttctagcattaaaggaaaaattaaaaatcacacaacttctattgagtctttaaacggaattgtcggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctataaaaacgaatgaaactaacattgcggcagtcacacatgaagtaaatacagctaaagacaatatatcctctttacagagcagcgttcaagctctacaagaagcaggttatattcctgaagctccaaaagatggccaagcttacgttcgtaaagacggcgaatgggtactactttctacctttttatcaccagcataacatggggccgcaaggccccaaaggattttaaatgtcaggatataattctcagaatccaaaggaactcaaagatgtcattctaagacgtttaggggctccaattatcaatgttgagttaacacccgatcaaatctacgattgcatccagcgtgccctagaattatacggtgaataccattttgatggacttaacaaaggttttcatgtattttatgtaggagatgacgaagaaaaatataagaccggagtcttcgatttaagaggttcaaacgtattcgcagtaactcgaattttgcgtacaaatgttggatcaataacgtcaatggacggaaacgctacatatccatggtttactgattttcttttaggaatggctggtattaatggcggtatggggacttcttgtaatagattttatggaccaaatgcctttggagctgatttaggatattttacccagcttaccagttacatgggaatgatgcaagatatgctctctcctattccagacttttggtttaattcagcaaatgaacagctcaaagtcatgggaaacttccaaaaatatgatttaattatcgtagaaagctggactaaatcatacattgatacaaacaaaatggttggaaatacagtaggatatggaacagtcggtccacaagatagttggtcattatctgaacgatacaataatccagaccataatttagtaggtcgtgttgtcggtcaagatccaaatgttaagcaaggtgcttacaataatcgttgggtgaaagactatgcaacagctttagctaaagaattgaatggtcaaattttagcgcgtcaccagggaatgatgcttccaggcggtgttacgattgatggacaacgtttaatagaagaagctcgtttagaaaaagaagcactacgcgaagaattatacttgcttgaccctccatttggaatttttgtaggttaatatggctacttatgataaaaatctttttgctaaattggaaaaccgcacaggttattctcagaccaatgaaactgaaatattaaatccttatgtaaatttcaatcattataaaaacagccaaatattagctgatgtattagtagctgaaagcattcaaatgcgaggtgtagaatgctattatgttccaagagagtatgtttcccctgatttggtattcggcgaagacttaaaaaataaatttactaaagcttggaaatttgctgcatatttaaattcatttgaaggatatgaaggagctaaatcgttctttggtaactttggtatgcaagtacaagacgaagtgactttatctattaacccaaatttatttaagcatcaagttaacggaaaagaaccgaaagaaggcgatttgatatattttcctatggataacagcttatttgaaattaactgggttgaaccatatgatccattttatcaattaggccaaaacgctattcgtaaaattacagcaggtaaattcatttattctggagaagaaattaatccagttctacagaaaaatgaaggaattaacattccagaatttagtgaattagaattaaatcctgttcgcaatcttaatggcattcatgatattaatattgatcagtatgctgaagtagatcaaattaattctgaagctaaagaatatgttgaaccttatgttgttgtcaataatagaggcaaatcttttgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcgataaattcacaagaagatgtggccaaggttgaaactattctacctcgtataaatttgcatttagttgattttagctataatgctccatttaaaacaaacattttaaatcagaatttactgcaaaaaggcgcaacttctgtagtatcacagtataatccatctcctattaaaatgatttatgaattgagtatctttactcgttacgaagacgatatgtttcaaatagttgagcagattcttccatattttcaacctcattttaatacaactatgtacgaacagtttggaaatgatattccatttaaaagggatattaaaattgtactgatgtctgctgctatagatgaagctatagatggagataatttatctcgtcgtagaattgaatggtcactaacatttgaagtaaatgggtggatgtatcctccagtagatgatgcagaaggattaattcgtactacttatacagattttcacgccaatacaagagatttgcctgatggcgaaggtgtttttgaatctgtagatagcgaagttgttcctcgagatattaacccagaggactgggatggaacagtaaaacaaactttcactagcaatgtaaatagaccaacaccgccagaacctcctggcccaagaacatagaggttattatggaaggtcttgatataaacaaacttttagatatttctgacctccccggaattgacggggaggaaattaaagtatatgaacctctgcaattagtagaagttaaaagcaatcctcaaaaccgtactccagacttagaagatgattatggagtagttcgtcgaaatatgcattttcaacaacaaatgctaatggacgcggccaagatttttcttgagacagcaaagaatgctgattctcctcgtcacatggaagtatttgcaactcttatggggcaaatgactacgacgaacagagaaatactgaagcttcataaagatatgaaagatattacatctgagcaggttggcactaaaggcgctgttcctacaggtcaaatgaatattcagaacgcgacagtattcatgggttcaccaacagaattaatggacgaaattggtgatgcttacgaggctcaagaagctcgtgagaaggtgataaatggaacaaccgattaatgcattaaatgatttccatccattaaatgaagctggaaaaattttaataaaacacccaagcttagcagaaagaaaagatgaagatggaattcattggataaaatcacagtgggatggaaaatggtatcctgaaaaattcagtgattatcttcgtttacacaaaatagtaaaaatcccaaataattctgataagcctgaattatttcaaacttataaagataagaataataaaagatctcggtatatgggtcttcctaacttaaaacgagctaatattaaaacacaatggactcgtgaaatggttgaggaatggaaaaaatgccgagatgatattgtatattttgcagaaacatactgcgccattactcatatcgactatggtgtcataaaggttcaattacgtgactatcagcgtgatatgctcaaaataatgtcatctaaacgtatgactgtttgtaatctatcacgtcagcttggtaaaacaactgtagtagctatttttcttgcacactttgtatgttttaacaaggataaagctgtaggtattcttgcgcacaaaggttcaatgtctgcggaagttttagatcgtactaagcaagcaattgaactgcttcctgactttttacagcctggtatagttgaatggaataagggttcaattgaactagataatggttcttcaattggcgcttatgcttcctctcctgacgcagttcgtggtaactcatttgcaatgatttatattgacgaatgtgcatttattccaaacttccatgattcctggcttgctattcaaccagtaatttcatctggtcgtcgttcgaaaattattattactacgactcctaatggattaaatcatttttatgatatttggactgctgccgttgaaggtaaatcagggtttgaaccatacaccgctatttggaattcagttaaggaacgtctttataacgatgaagatatttttgacgatggatggcaatggagcatacaaaccattaatggttctactttagcacaattccgtcaagaacataccgcagcgtttgaagggacttctggtacattaatttcaggaatgaaattggctgttatggatttcattgaagtaactccagatgatcatggttttcatcgatttaaaggacctgaaccagatagaaaatacattgcaactttagactgttcagaaggtcgtgggcaagattaccacgctttacatattattgatgttaccgatgatgtgtgggaacaggttggtgttttacattcaaataccatttctcatttaattctgcctgacatcgttatgcgttatttagtagaatataatgaatgtccagtttatattgaattaaatagtactggtgtgtcagttgcgaaatcactttacatggatttagaatacgaaggcgttatttgcgattcatatactgatttaggaatgaagcaaactaaacgaacgaaagcagtaggatgctctacattaaaagaccttattgaaaaagataagcttattattcatcaccgtgcaactattcaagaatttagaacgtttagtgaaaaaggcgtgtcttgggcggctgaagaaggttatcatgacgatttagtaatgtctttagtaatttttggatggttatcaacacaatcaaaatttattgattatgccgacaaagatgacatgcgattagcatctgaagtgttttcaaaagagcttcaagatatgggggatgaatacgctccagttatatttgttgattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaacgaagtagatttagttaatacttttggtcaacctacagctgaaactgctgactattttatgtctgcaatgaatttcttacaatatggaaatgatttgcgagttgtgcgcgctgtcgatagagataccgctaaaaactcatctccgattgctggtaatattgaatacacaatttctaccccaggtagtaactacgcggttggagataaaatcacggtcaaatatgtttcagaagatgttgaaacagaaggtaaaattaccgaagtagatgctgatggaaaaattaagaaaattaatattcctactgcaaaaattattgctaaagctaaagaagttggcgaatacccaacattaggttctaactggactgcagaaatttcttcatcttcttccggtttagctgcagtaataactcttggaaaaattattactgattccggtattttattagctgaaatcgagagcgctgaaactgctatgacagcagttgattttcaggcaaatcttgaaaaatatggaattccaggagtagtagctctctatccaggcgaattaggcgataaaattgaaattgaaatcgtatctaaagctgactatgcgaaaggcgcttctgcattactgccaatttatccaggtggtggtactcgtgcatctactgccaaggcagtatttggatatgggccgcagactgactcacagtacgctattatagttcgtcgaaatgatgctattgttcaaagcgttgttctttcaactaagcgtggtgaaaaagatatttacgatagtaacatctatattgatgactttttcgcaaaaggtggttcagaatatattttcgcaactgcgcaaaactggccagaaggcttctctggaattttaactctgtctggtggattatcatcaaatgctgaagtaacagcaggagatttgatggaagcttgggacttctttgctgaccgcgaatctgttgacgttcagttgtttattgcgggttcttgtgccggtgaatctttagaaacagcatctactgtccaaaaacacgtcgtttcaattggagatgctcgccaagattgcttagtattgtgctcaccaccgcgtgaaactgttgttggaattcctgtaactcgtgcagtagataatttagttaactggagaactgcggcaggttcatatactgataataactttaatattagttcaacctacgcagcaattgatggtaactacaaatatcagtatgacaaatataatgatgtaaatcgttgggttccattagcagctgacattgctggtttatgcgcgagaactgataacgtttctcagacttggatgtctccagctggttataatcgtggtcagattcttaacgttattaaacttgctattgaaactcgccaagctcagcgcgaccgtttatatcaagaagctatcaacccagtaactggtacaggtggtgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccaatacttacagggaattaaagctctcggtggaatttatgaatatcgtgtagtttgcgatacaacaaataacactccgtcagtaattgatagaaatgagtttgttgcaacattctacattcaaccggctagaagcattaactacattaccttgaacttcgtagcaactgctactggtgcagatttcgatgagttaactggtcttgctggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagtcggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagagcgctattgttcgtcaatatgctcgtgatgctaaaacagtaacaaaagaaattgaaattaaaggtctgtggcctactaacgtgggtgaacttcaattagattgggattcaaacaatgaaatccaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtagataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggtgctgataatactggcaatatggaagatattcgttggtttagacaagctctttacatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccacttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtaccaatgcttgaatctcatgatggaaaagacttaggtttaaaaccgggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccacggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgaacacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgccgcaggtcagacttctggcgcagtaactcagattggcccagctgttatgggtatggtacgtcgtgctattcctaacctgattgctttcgatatttgtggtgttcagccaatgaacagcccgactggccaggtattcgcgctgcgcgcagtatatggtaaagatccaatcgcttccggcgctaaagaagcattccacccaatgtatggtccagatgcaatgttctctggtcagggtgctgctaagaaattcgctgctttgaaagcaagtgatactcttgaagtcggaactatttacactcacttcttccaggaaactggtacagtatatctgcaagctacagcagctaaacaaattgattcaggcgcatctgacgcagacaaattagatgctgaaattaagaaacaaatggaagctggtgtactggtagaaatcgctgaaggtatggctacttctatcgctgaacttcaggaaggtttcaacggttctaccgataacccatggaatgaaatgggcttccgtatcgataaacaagttatcgaagctaaatctcgtcagctgaaagctgcttactctattgaattagcacaagacctccgcgctgttcatggtatggatgctgatgctgaactgtctggtattctggctacagaaattatgctggaaatcaaccgcgaagttgttgattggattaactactccgctcaggttggtaaatctggtatgaccctgactccgggttctaaagctggtgtatttgacttccaggacccaatcgatattcgtggtgctcgctgggcaggtgaatcctttaaagctctgttgttccagattgacaaagaagcagttgaaattgctcgtcagactggtcgcggcgaaggtaacttcattatcgcttcccgtaacgtagttaacgttctggcttcagttgataccggcatttcttatgctgcacagggtctggctaccggctttaacactgatactaccaagtcagtatttgctggtgttctgggtggtaaataccgtgtatatatcgaccagtatgctaaacaggattatttcactgtaggttataaaggtccgaacgaaatggatgctggtatttactacgctccatatgtagctctgactccgctgcgtggttccgatccgaagaacttccaaccggtaatgggattcaaaactcgttacggtatcggtatcaacccatttgcagaatccgctgctcaggctccggcttctcgcatccagagcggtatgccttctattctgaatagccttggtaaaaatgcttacttccgccgtgtatatgttaaaggtatctaatctttgacgatttaagggaccttcgggtccctttagttgtttttatggtataaataaatcatataaaccaaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccagacaatgaatttacatttaaaactggtgctacttatgctggcgaagctggatatgtagaccgagaacaaatcacagaattaacagaagagtctaaattaactctcaataagggcgatttattcaaatataataatatcgtttataaagtattagaagatacaccatttgctgatattgaagaaagcgatttagaattagctcttcagattgcaattgttcttttaaaggttcgtctattttctgacgcagcgtcaacaagcaaatttgaaagctctgatagtgaaattgcggatgctagattccagattaataaatggcaaaccgcagttaaatctcgtaaacttaaaactggtatcacagttgaattagcacaagatttagaagcaaatggattcgatgctcctaatttcttggaagatttgcttgcaactgaaatggcagatgaaatcaataaagatattctgcagtctttgattacagtgtcaaaacgctataaagttacaggaattactgatactggattcatcgatttgagttatgcatctgcacctgaagctggtcgttcattataccgaatggtatgtgaaatggtttcgcatatccaaaaagaatcaacttatacagcaacgttctgtgttgcttcagctcgtgccgctgcgattcttgctgcatcaggttggttaaaacataaaccagaagatgataaatatctttcacaaaatgcctacgggttcttagctaatggtttaccgctttattgcgataccaacagtccattagattatgtaatcgttggcgtagtagaaaatattggtgaaaaagaaattgttggatcaattttctatgctccgtatacagaaggtcttgacttagatgaccctgaacatgtaggtgcatttaaagttgtagttgatccagaaagtttgcagccatctatcggtttattagttagatatgctttatctgcaaatccttacactgtagcaaaagatgaaaaagaagcaagagtaattgatggtggagatatggataaaatggcgggtcgttcagatttgtctgttttattaggtgttaagctaccaaaaattatcattgatgaataaaacaaagggaccgaaaggtccctttttatttaacttaccaattcaatccaagccggacgaagtacatcttgtaccattttaactaattccttcttaatcaaagaaggattatccgcttgagttagagtaataccttcacgagaagtttcttccaaaatatcttgaacagttagccccatcacctttccaaaatcttttggaccaatttcaccaattttagaaataacgttatttactcggttcagtgtaacgtaacaagctaaaattccaaccaatttgttatcagcttctgacagttcaactttagctttaataggcttatcagactttttcttttcactaaatttagagttcttgcatttgatagctacgcgattgccattaggcatccaagaaggataacaaggtttcaatacatatccttcagcggtaaatacttcgccttttacttcagcattccaaacgcatttatttgcatcaactaatccagcatggtctaccgtaaaattataatcctggacgacagaatctaaatcatttggcaatttaataagttcttcaaatttaccgcgacctaaaagtggagccattttaaatttaaatgtattgcagaatgattccatcatataatcatcgacataagtcacatcaccactttctgtagtaacaataatgtcaaatacataaaaatctttatcgccataatcgacattcttctgaatgccaggtccagcgaattcgccaaaaacttgataagatacaaccgctgaagtttccataatatcttgtactgctttaatggaatcagagtaattcttcaaaataatttcatacccaaagaaatcttcagcaggaagaataggaccagtgcgtttagcgcaagttactttatcacgctcaataatcaatgagaaatttgtgccgtgaatcttttcacgagctacccactccccaccagtcaatcccaagctataaagtttttcaataaatttagagttgtaatgattttcaagactgctatactttttaaacataattaatcctcaaaatgtaatttctaaccaatcaccatcacgctgatcactattgactttaaagctaaatccttcttttctcagccaatcaccaatttcttcagtaatcaatttatcgcgagcagtacaataataactaaaatatgttttaccttgttcagctgctttattagcaagttccgaaaaatctttaataaaacactctagcttaaactgtttacttttaagtgctttttcgcgtaatcgattagcaaaagattcattttcataaagatcatactgttccatttttcaccttttattaatatgtctttttctatagacaactttttctcgagtttcaaatttattcttagcagtcatagctcgagcccataatacagccacttctttcgcctgtaagtttaattcacgagcaatttcaatgaatgactttccagactcatgaagagtaaacaccacaacctcagttctcataatcaatctcatgttatcgagttgatgccattatatacatcattttctgagtatgttttgtgtgctttcaaaatgaagaaaggggccgaagccccttatgattatgattatgattatggataggtatagatgataccagtttctaaagcagttttatgaatgatgtatccattgcgtgattcttgaacatcaacttctggatagtctttcatcatcttctgaagagtgtaacgatgcaggtagtatttactgtctggatcttcagttttccaatctttaccttcttcggtcattttttggatttcatccataacccaccaaccgcaccagatataagctgaagtacgatgtggaagaggatgaacataaggcaattcaccttctggttctggagcaactttatcagttacctgaacttgaccttctgctgtaatagttttgctatcgtaatcagttgcagtaacgacagcagtaacttcaatagtttgacttccaacagatgaggtatcgacagtatatacgttagttgacccttctacaagagaagaatctttcttccatgagtaagtaatttgtgcttcttctggagcacccgtaacattagccgtaaatgtagccgaagcatcttgctgaacgttaatagaaggaggagtcaatgtaacctgtggattcattgttttcgtttgcacctgatggctgtgaagctaaggcagcggtaaattcaattggagttccaatcactccagcagcaggattagcaggagttacggctaacgtagttgtttgtgtcttattttgaactgtgatagttgtactaatttctgctgtttcaggttcagattctgcaacttgattggttgcaactactttaatagtcttttgaccggcaggtccttttagtacataactaaaagttgctgacgtttcttcctgtggagcgtcgtctacagtccaagcatatgtaataggtccatctccagtttgaccactgggtgtagcagtaaactgctgagtctgatctataactccagtaggtgttttaggagttatatcaactgtaaaagccataagttatccttattttaatgttacgaaagaagaattacgtgtttcacgaattagaactgatccgtcacgattaatgtagtaaattaagctaaataaagtttggtgtgccgacgcatgttcaaaactagttgggtgagatttccaatctggggtttcagcaatccattgataaatccaccaaggaacagtgcagaatcctggattttttccaatcagctgaagattcggactaaagttttccggaagagtaaatacagacggcttttcagattcaataatctcagctacagcctgttcgaatttttcttcaacaaaaggagtatcttcaattaaaacagtggtattttcaggaattttatccgtttctactacttcaattttaatgtcagatttaaccggagaatcaatcagaagtgctgcctctggattgacttcttcatcgtcatattttaatccgtctgcggcatcagcagcatcaattaagtctttaatagataacccatcagtctctggcataggttcactagcgagcttctggagagcttcttcaatatcattaacgatattatcaaaagatttattctttttgacctttataccaaactgttcagcatattcagctaatttagctttagcttctttattatcatcaagagccttcagctctgcaatataatctttatctatcataatatttcctcagtataaatatagatatatttattacatggtatttagacatgactgacattaaagtacatttttatgattttagtcacgtgagaattgattgtgaagaaagtacatttcatgaactccgtgatttctttagctttgaagctgatgggtatcgttttaatccgaagtacagatatggccactgggatggacgaattcgtcttttagattataatcgccttcttccattcggtttagtcgggcaaattaaaaagttctgcgataactttggctataaagcctggattgacccacagattaacgaaaaagaagaattatcaagaaaagattttgatgaatggctttctaaattagaaatctattcaggaaataaaagaattgaaccgcattggtatcaaaaagatgcagtgttcgaaggattagttaatcgtcgtagaattcttaatcttccaacatccgcaggtaaatctttaattcaagctttgcttgctcggtattatttggaaaattatgaaggcaaaattcttattattgttccaacaactgctctgacaactcagatggctgatgactttgttgactatcgtttattcagtcatgcaatgataaagaaaatcggtggtggagcatcaaaagatgataaatataaaaatgatgcaccggtcgttgttggtacatggcaaactgtagtaaaacaaccgaaagaatggttctcacagtttggaatgatgatgaatgatgaatgtcatcttgctacaggaaaaagtatttcatctatcatatcaggtttaaataactgcatgttcaaattcggtttgtctggttcattacgtgatggcaaagccaatatcatgcagtatgttggaatgtttggtgaaatatttaagccagtaacgacctctaaattaatggaagatggacaagtaactgagttaaaaattaatagtatttttcttcgctatcccgatgagttcactactaaattaaagggaaaaacttaccaagaagaaataaaaattattactgggcttagtaaaagaaataaatggatcgctaaattagctattaagcttgcacaaaaagatgaaaacgcttttgtcatgtttaaacacgtatcgcacggtaaagctattttcgatttaattaaaaatgaatacgataaagtttattacgtatcaggggaagttgataccgaaacccgcaatataatgaaaaccttagctgaaaacggtaaaggaataattatagtagctagttatggtgtattttctactggtatttcagttaaaaatctgcatcacgttgttttagcacacggtgttaaatctaaaattattgtattgcaaacaataggtcgcgtattacgtaaacatggttctaaaacaatcgcaacagtctgggacctcatagatgactgtggtgtcaagccaaaatctgctaatactaaaaagaaatatgttcacttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgcgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaagaacatcttcaccgcacgggtggtcggccaggatacgaatatcctgacgcttaagattatgctttttcattaagaattgaatttccgtttcaaattcttcttcataattaaaagcatcatcaatgctatatctcattattttccagcctcaaatgctcgcatgtcttgaatatgcttaatagcaaatccacgtgatttaatagcatcaagagctccgctacagaaatctaataaaatcccccaatactgtaacgaggtatcaacctttaaaacatccttatcagctgatagaactgtcttcatttctgatttctcgtaacgatccatactaaattcatcaccatctcctcgtcccgagtagtagtctaatttagctttaagagcaacttttttctgtgcatcaattctaagcatttcctttttaatacttgaatgcttattaagccatttactatataacatcacattattagctgcttcatactgtaatttagtcgaatctataaatacatctttcttcaattcttcttgaagatcttctaatctcatattgttctctattcaattgttattggatggacttagattcattataccacgtttatacgtgaagcattatactctattactggaagccagttgtagttttatctgctcaatatcatcagggttatcgatgactgaaaagcgtatttctactatcaaagtataatcatcataaaccggtattacattaactgctaatttatcaatacgtggctcatagtttcttactgcgctttcgatattacgctcaaccgtgtcagcagtaagaggagtcatattctcaaaaagttggtcagataaatcgcatccaaattcagggtcaaacggtcttgaaccttttcttgttgtaataattcctaaaagactatttttaattgaccttaatccaagtgatcttgaaacgtctttgttccaatccattttcatctctgggtcaatatcagaataaagcttattaatatttgccattacaatagctcaaagaattctttgagtcctcttattacatgagcgtgagtttttccacactctggacatttaattggaacagccaaataaacagtaggctttaaaagcatatcttttatagctacaatatctgactctgtgatgatagaatataaatcttccagttctttttcatttaagtcttcaactggaatgctttcaccattagcatgaatcgtttctatacatgatactatcatgtgggctatatttttatcatcaaaaattttagggtaatggaatttaattttaatgtcaccaagtgtataccaaaggtcttctggtgcatctatttgtgtatgtaatagatttatatgggttggtatttcagttccgcaggtgcacttccaggagttttcgtgattaacttctccaagagaatgcgcccataaatgaatcaacaatagttctgattcttggcgatttaaatcttttgcatttgtgcagtctttgattagctttttaacaattacttctacagaaccattatttttggcagtaataagttctagatattctttaagagtaaatgcgcgacagttgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagaacatcggtcaccacaagaacaaaaagaaataattactgatttaattgatgattattttggagactatccgaagacttggcaaccatttatatttttgcaggtatttgtaggttcaataggtaaaactaaagtaccagtcacatttgtatgtccaaaatgtaaaaaagaaaagacagttccatttgaaatatatcaaaaagaattaaaggaacctatttttgatgtagctaatgttaaaattaaattaaattttccttctgagttttatgaaaataaagcaaagatgattactgaaaatattcattctgttcaagtagatgaaatgtggtatgattggaaggaaattagtgaatcgagtcaaatagaacttgttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgagcgcggattcgtattaaaactgattgagaaggataaacatcaatgagtatgttacaacgtcctggatatccaaatctcagcgttaaattatttgagagttatgacgcttggagtaataatagatttgttgaattagctgctactattaccacattaactatgcgtgactctctttatggtcgaaatgaaggaatgctgcagttttatgattctaaaaatatccacacaaaaatggatggaaatgaaataattcaaatttctgtagctaatgcaaacgatattaataatgttaaaacacgaatttatggatgcaagcatttttccgtgtcagtagattcaaaaggcgataacatcattgctattgaattgggaactattcattctatagaaaatcttaaatttggtagaccatttttccctgatgcaggtgaatctataaaagaaatgcttggtgtcatttatcaagaccgcacattattaactccagcaataaatgctataaatgcttatgttcctgatattccatggactagtacatttgaaaattatttgtcctatgtaagagaagttgctctagctgtaggaagtgacaaatttgtatttgtgtggcaagacatcatgggagttaacatgatggactatgatatgatgataaatcaagaaccatatccaatgattgtaggtgagccatctttaataggtcaattcatccaagaattaaaatatccattggcatatgattttgtttggttgactaaatcaaacccgcataaacgtgatccaatgaaaaatgctactatctatgctcattcgtttttagattcttcactgccaatgattactacaggaaagggtgaaaactctattgtagtgtcaaggtcaggtgcttattctgaaatgacttataggaatggctatgaagaagctattcgtcttcaaactatggcgcaatatgatggctatgctaaatgttctactgtcggtaattttaacttgactcctggtgttaaaattatttttaatgatagtaaaaaccaatttaaaacagaattttacgttgatgaagttatccatgaattatcaaataataattcagtaactcatctatatatgttcactaatgcaacgaaactggaaacaatagacccagttaaggttaaaaatgaatttaaatctgatactaccactgaagaaagtagttcttccaataagcaataaagaagtttctattcctaaaatgggtcttaaacattataacattttaaaagatgttaaaggccctgatgaaaatttaaaacttcttattgattctatttgtccgaatttgtcaccggcagaagttgatttcgtttctattcatttattggaatttaatggaaagattaaatctcgtaaagaaatagatggctatacttatgacattaatgatgtttatgtatgccaaagattagaatttcaataccaaggaaatacattttattttagacctcctggaaaatttgaacaatttttaacggtgagcgatatgttatctaaatgcttgcttaaggtcaacgatgaagttaaagaaattaattttcttgagatgccagcattcgttttaaaatgggcaaatgatatttttacaactttagcaattcctggccctaatggtccaataactggaattggcaatattattggattatttgaatgaaaaagccacaagaaatgcaaacgatgcgtagaaaagttatttcagataataaaccagttcaggaagcggctaaatccgcttctaacactttatctgggcttaatgacatttctacaaaattggatgatgctcaagctgcctctgaattaatagctcagactgttgaagaaaaatcaaatgaaatagttggagcaattgataacgttgaaagcgcagtaagtgatactactgccggttctgagttaattgccgagactgttgaaattggcaataatatcaataaagaaataggcgaatcactcggaagcaaattagataaattaacgagtttattagaacaaaaaattcaaacagctggaattcaacagactggaacgagtttagcagtagtcgaaaatgctattcctgttaaagtcgtcgaggatgatacagctgaatctgtgggtcctttattaccggctcctgaagcagttaataatgatcctgatgctgattttttccctactcctcagccaattgaaccaaaacaagagtctccagaagagaagcaaaaaagagacgcatttaacttaaaattatctcaagctttagataaattaacaaagacagttgatttcggatttaagaaatctatttcaattactgataaaatatctagcatgctatttaagtataccgtcagtgctgctattgaagctgctaaaatggttgcattgataatggctgttgttattggaatagacctgctgatggttcattttaaatactggtcagataaattttcaaaagcctgggatttatttagcactgattttaaaactttctcaagcgaaacaggaacttggggccctttattacaaagcatctttgaatctattgatgaaattaaaaagttctgggaagctggagattggggcggattaacagtagctattgttgaagggcttggaagtgttctttataatttaggagagcttattcaattaggtatggctaaattatctgcagcaattcttcgagtcattcctggcatgaaggatactgctgatgaagtagaaggaagagcattagaaaatttccaaaattctactggagcatctcttaataaagaagaccaagaaaaagtagcaaattatcaagataaacgaatgaatgatgatcttggcccaatagcaaaaggattagacaaaattgcgaactggaaaactcgtgcatctaactggattcgtggtgtagataataaagaagcattgactactgacgaagaacgtgcagcagaagaagaaaaattaaaacaactttcaccggaagaaagaaaaaatgctttaatgaaagctaatgaagctcgtgctgcgatgattcgttttgaaaaatacgctgattcagctgatatgagcaaagactcgacagttaaatcaattgaagctgctcatgaagaccttaaaaaacgaatgaatgatccggatttaaataattcaccagcagttaaaaaagaacttgcttctagatttgctaaaattgatgccacttatcaagagctcaagaaaaatcaacctgaagcaaaacctgaaacttctgctaaatcaccagaagcaaaacaggtccaggtgattgaaaagaacaaagcacaacaagctcctgttcaacaagcatctccttcaatcaataatactaataatgttattaagaaaaatactgtcgttcataatatgacacctgtcacaagcacaactgctcctggtgtatttggtgcgacgggagttaattaaggaataatatggcaattgttaaagaaataactgctgatttaattaaaaagtccggtgagaaaatttcagccggacagagtactaaatcagaagtaggaactaaaacatacacagcccagtttccaactgggcgtgctagtgggaatgacactacaggggacttccaggtaacagatctatataagaatggattattatttactgcatacaatatgtcatctagggattctggaagtcttagaacgatgagatctaactactcttcttcatcttcgagtattttacgtacagccagaaacactatcagtaatacagtatcaaaactatcaaatggactaatatcaaataataattcaggaacaataagtaaagttcctgttgcaaatattcttttacctagatctaaatctgacgtcgatacgtcatcacatagatttaatgatgttcaagatagtcttattacaaaaggtggaggtactgctactggtgtgctaagcaatatggcttcaacagcagtatttggagcgctggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatctagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgataaaacacctaatggtaactttaacggattagctattgctccaaatctccctagtacatttactctcgagattactatgagagaaattatcacgttaaaccgtgcttctttatatgcggggactttttaatgtattctttagaggaatttaataatcaagcaataaacgcagatttccaacgtaataatatgttcagctgtgtttttgctacaactccatcaactaaaagctcttcgttgataagttcaattagcaacttttcttataataacttgggcctaaattcagattggttaggattaactcaaggcgatattaatcagggaattactacgctaattacagctggcacacaaaaactgataagaaaatcaggggttagtaaatatcttattggtgccatgagtcaacgtacagttcaaagtttattaggctcatttacagttggtacatatttaattgacttctttaacatggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggcagatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtgatgcaggctggagcagttgatagacaagctgccattgaatggcttgaatctgctactataaatggtattcaaagcgttctcggaaatagtggaggtgttactggactatctaattcgctttcacgacttagtagattagggggaactgcaggaagcatttcaaatattaatactatgacaggaattgtcaattcgcaaagtaaaatattaggagcaatataacaatggggaccgaaaggtccccatattttatttacggaatgaaataaaagcagcaactgaagcaacagaggtttcttcaatataaacctcaatttttaccggagcttctgactcaaatttacctgttactacaccttggaaaatactttcagtctgttctggctttgaaaaattttcagaaggaaaaattccgaactttttatctgttccaaaaattttgataaattcatcataaactgcttcattaaaagcgttatcagcaggaataacgccttcaactacaagttcttgacctaaaaagcgtaaagaagatttcattttgtgttcctcatgttatgtcagtaagattactataacacaacacgagggacttgtaaactacattttgaactttttagacattccgttgatgttaaccaaagaagctaagatttgagaaacttcgctttcctcttcttttgattcttctacaaggaattgattaaatccagccattggacgaacttcaccagtttccattagatggtcgccatcatatactgattcttctaattgttcagaaggaggaacgattgtaccttcgattagatacttgttataagcagtttctttcataaagtacgtacttactttattaatcttcagtaaaattccacgtggtagaataacttcagcttctgatggaaatcctgataaatgacctggaacgataactttgattcgctcagctcctttaattaccatacccacgctagtttcagcatcttcattagcatatgtagaatgactacccatatgcatcaaatcttctgcatcaacggaaccttctccttcgccagaaaatactgcgccagaatcatctagagccatatagtttttaccatgctcaccgaagatatttggtttaagcgatgtggatacgaagttcttgaaatagaacattttgttttcaatgttatgacgcaaagttttaaaggtaacttcttgcccacggtaaagtgtagttcctggaggaagaactgatcctttggcaaaggcagaatcaagcgtctcgatgtgcttaatagctcgttccatgtattcttcacgggtagaatctggtttacccaaaaggaacgagttcatttcaacatatgaatctgcacaataatcttcaattacatcagattcagcctgagtcagtccttttggagctacttcggtgcttgcgtattcatatgcctgggcagcagattcattaatcaatttataaatgccattcattacaaattgaataatagctgtcttttcatctggcgtggctttagaacctttaaccaaatcattgataattttcttaataacatcaaagctattagaaatattaatgtcagcaagatcgcttaaaattttatcagttttataatcaaagaattctttattctttaaatattcttgagaaccttgatatgttatatcgctctgcaacttgatagatggatcacgtaaacgtgcatgggccaatgcaatatgatttcggaagctttctagttcataatcgttagatttaaaacgagaagcacttctcataccaccgatagctcctttgctgaagtttgaaccaatctggataacgccagagttcatcggaccttctgctttatataccggaactttagattcaaactcttgatatttcttagcagcgaagctatcaccctgaagcgaagcatcaacagtagaatattgagcttgtgctgctaatcgacgactaattttagttttctgaataacagcttggtccgtgcgcttatcattttctaaagcaatagaagcagcaacagcaacagctttaggaacagcatttcctgttttaacgtctacataaacatcaccgacctttgattcaacttttgtgaataactcagttgaaataggaggtacacctggaatgtcttctaaattggcatttttacggtaaaccataatatatgcatatttcttatcatagtcccagatttcctttaaaagaacatatcgacctgctcctttagtacgtactaaacggtcagcaataacttgcatttgacgagctgcgccatttgttttactttttagtacgcggaataggcatgcgtcgattttatactgtttcattgtttgaagagcagtatcaaaaacggcattaatgacaccaattggatttccacccaagtttttaagcttaactaatgatagtttctcattaacacctatcattacgatatgcatcattttatcgcctggcttaacgtttttattcgtatcaccaccagaggtatatgtacaaaatctaaatccaggaagcacgctttcttcgccggcttgaatagcaaaaatttgtggtattttatgcttaggatttaagttaacaaccggcgccgaagcgccgtcaaataattctgtaataagttccatgatttatccttgaacgaacttgtaaggcatgtttgcaatatctatacaagacgcaataattccaagagatgattctactttctgtttaacgtttgatgaaacaaatgatgcaaagtcaactctgtcttctatttcaatatcacctgtcattgcaactacttcgccggtttccattagacggtcaccgtcataaattaccgattcggtgagttcttctgtggtcataacttcagcttgaataagcttgttgttagttttaactgttccatcattgtaagatgcatcggttattttattaactttgaccattaatccacgtggcaaaatgacttccatttcatttgaaggtgctaaacttccacctggtaaaacaacattaactttatcagccccagtaataacccatccaattccaactaaattatcgctagaatttactagtccttcatcagttttatcaatagaaacacttaaacgcttttcgtctggtaaaacacccacagatgaatcagtcatccaggtaccaaaaatatttggatataatgatgttgacacaaagtttctaaaataaaaaactcgattttttaccagtgcttcatatattgaaggtaacattcgttgtgaacgatacaaagtaataccttttggtaatcgttcaccatttttaaaggcagaatctaaattatcaatagctttttctatatcagatgctgtcaaaatacttgtacgctcatctggattatataatcccaaaagagcgttatttatgtctacatatcctgaacttacgtattcacgaattccgcgtttttgtgccggtgtgtatttagatgaatctttattttcgactataggatgtagtaaccatccagcggtaagagcatatccacgcaattctcttcgaataatctttgtttttattgcattccaagaattttgtactaactcattcgcagcatcttgatttaaatgcgaatgcttgttaatgtttctttctaaccaagcacctttatatttttctaaagtatcatcaactatagaagcaatagtttctaaagtttttattgaagtaatagattcttttcgtaatctttctaaagctttattttttatttctgcattaacatcagattctttatcttcaggaattatagaagcttctctgaatgccattccagctgtaacactactaagagcattctctaatgcaaatcctgaagtagaaataacagttaattcattagcgtcagaaattaaaggagcgtcagcaggtttatttaattctgctgctgaagcctcaaatttttgaaacatcggcgtttcaaatctagaagattccaatgattgactttgcgcaattgctctacgggaaattttaactttaacgattacagcttggtcagaacgtttatcattttcttgcgcaatagatgctgcaattgcctcatttttagttacttgagctccagtatctttattgatataaacatcaccgaccttcgattcaactttagtaaagagctcagtactaatttccggaactcccggaatgtcttctagtgatacatttttgcgatgtataagaatatatgcatactttttatcgtaatcccagagttccttaagaaggacgtatctgccacctgaacgactacggataagtctatcagcaataacttgaatttgtcgagcttgaccagcggttttagacttaagaatacgaagcatacaggcatcaattttatactgacgcattgtttgcatcgcaacagtaaaaactgaattgatataattaattgggcttggaccaagaccttttaatttagcaattgaacctttagcagttaatgtaaaaggaacaatatgcatcattttatcgcccatctttaaatcgcgattagtatcacctccagatgtataggtacataaacgaaagcctggttgttcaattgcatcatcaacatgaactgaaaaaatttgcggtattttcttctttggatttaagtttgtaatcggaagagtagtatcttcgtcaaataattctgtaataagttccatcatagcctctctagtgtttattctatttataaaattaaaggcccgaaggcctttaataatctagtggtaagagagtacggtatatttcaaactttggacctttttcataggcatcaaatgtttctgtgaatttattataagcgtatgcatctacaaattcgagaatgacttgtgatacagaagtagaaacatctccaccttctttttgagcaatgacaattgtttctaagtaagctttcataaaccagttacctcatgaaaatcaccaaatacatcctcgaatgtattagctttagttttatcttcacgcaaacgaatcgcaatcggaagaaataatttaacgtaatcagtgcggccatcagattttaaccaaccgttgcattcgcactctagaatttttccaatataataattttggttttccataatgcgagtacggtcaagttcatgcgattttacaccggctttatcttttaagcctgaaccagcatttactttaatttttccacactctgactcaagaataaatccacctgctttagtagggtctttacggtgaggataaattcctacaatttttaaatcaacatcaattacttctttaaatttatagagattttttgaacgagcattttcccataatccatcgatatttttgagaataataccttcaagaccttggtcaatatactttttataaattaccttggcttcgtctaggttatttactacctggttttcaattaaaattactttatcatagcctgatgtcatttgttctagtttagaaaaacgtacatcatatttcaaacgaaatgcaggaagaccgtatatttctaccaacggtacataatcccagacctgaaacttcatgcattgtgcttctttttcagaaatggttccctttaaagatttattggcgatgccattagatgcagtacgtgattcagctacttcggcgaattctttagctttactgttttcaggataagcatcaaaaagaaaatctaggccttctggctcctttttaacttgctcatggtataccaattcgccatcaattaacacgccttctggatgaatctggcgggcttcagcggtcattttgattaattcttccttaagaagatctaatcctagatattcattaccagctcgtgataaaagacgaacgtcatctaattcatcacctctgacttcggcaaagcaccgagctccatcagcttttaactgggcaaaggctggaaatttgatattcttattaatgcctttttcatcataagaacttgcgagcatttgaggttgttcaggaattaaacctggccaaactttgtttgcaatagatactgaagcaccacattcaaggtctcgcatcatcactcgacgcaaaacttcaacatcatcttttttaccgtcagtaatataacctactaattcctcaattgccgcatttccggtcaattttcgagtagctaatgtaaattcaatgaagtcaagcatatcagtaatagtcagcattccaaaactctgggtagcaataccaggtttaggccatttcttgatataatactgtaacccacgagaataagtcagacgatatacccgtttaagcaattcattatctttattcttttcaagaattgcttgcttttgtttagttgaaccaatagatgctatttcattcagaattttaagaatcattgttcatccttcagagtttgatttacagctctattataaatcaattcatcattaagctcagtcaaagacctatgatatgtggttctaactttatttccttgcatccagtgcttgacgtaaatgaaaccttgctctacacattttttaaaaattcgttcgtctttttgagctcggaattctggattgcatctaaaaaattgatttacgtgaccgtaatcacgcgtagtattaccttcattttcataaatagtgtgaacaacaaacattagaatgctccttggaaaatattattagcaccagtaggtctattatacaaatactctatgccaccgggtttaatatagttccatgtctgaaacggatgcgtctgatatggatgatatggatgatatggattataaggattaaatccaggagttctccaggtagtgttccaaggaaaagaatcgtttttaatcatcttttcaattacatcttttatagctttttcactatcaaaactttctttattttccttcggtgaaaaaagcttattttctacatcattccatgtataaactcgctgagcagtttttggaatattgtcacgctctcctcgagccatccaataaacaggaacatttaatatttcactcgcatgatcgcaatggtgagcgagatcgtcaatataacaaatcacgttatatttctcttttgcctttttaaacaactcttcttttgaagaatcatgaccacacatcagtacttctgagaaggcaccaggaaaaagagcgtttaaattaaattgacgattcagcagagcgtcaatagaatcacccaatgctgtaacagctacaaaattataatcttcttttaatttgttaattacacacagagcatctttatatggagacaagtaacgaataaaatctgaacgattgtatttttcaattagcttgacgccaagttcttcgtcacaattaaagagtttacctggagaaataaatttctcatcctggatcatttttaaaatatgttctaacggaagattatatttctgagcaaaataaggaagacctgattgccagcttaaacatactccatcaatatcagttaaaatagtaggcttcatagagagtctcttaataggtttaacacatcaataaattcagcttcggttagtattgtatcatcttttgttagaccactagccatgctgtgcttcaaaacttttcctttcgaggcttgtaatgcatcacgaaagcccttgttttgaatcgctgcttcaaaatatgcatttgtgtataattctttccacgccggggagtatcttgaaaatggaactccaagccagaagagggtcccacggtcctgagctctagcataagaccttccagcttgttgagcggcaagcccggataacccaaatatacgacgttgttgttcaacgtttttcaccttgcatccttggaggaatccttcaagacctccaaattgaataccatccataacgaaaggccaatgggcgaaattacttaatgcacatgatggccacctaaaattacttctaatctctaactcagacattttcaatgcttataatttcaacatcagcccaatgaccatagtttggtagacgaaattcaactggccagtcactgcctttttctaatataatagactcaatttgtggttcttcatgttcatcggtatatggatttttatctgttactttatatgtgaccttaatgtactgaattccaaaaatcttattaattatattcatactaattcctttaatccgtagataggagataattcatcacccatacgaaggtcttcatttccatctacccaggaaacaatataagcctcttttatttgaataccactccatttaaatggaggtaaaaccttagaaattaatccaggtataccaactccctttaattcaacggtttgacctaaaaagaatttcattaaaacctcatctgaaaaccgtgcgatttaacattaccgccgccaatatcagaaatgttaatttcacgcgcaattgaagggtcaatgtcaatttcgcgattgagtttagtgatagctaaagtatcgcgcccatttacagtacgaaactctaaaggacaaaccacatcaacgtagtttttaatcgattcgctagtaggttgcaaatgtgcaggaaggtctttaggtgcctttgagaaaaccacttcacaaaaatttttgcgggtatcaaaataagtagtcataaacataatattttcctcagtaaggggccgaaacccctcatttattttaaatatcaaattcgttaagaactacatcaaagattgcttccaagtgctcaggtttagctttgttactcagaatatgacgaatccaagttttaactaagagtttacgattagcaccattccagcaaggatgagtccctaaatcgcgttcacgaaaatcatcatccagagcgattttaaagttggaaccttccattgtgattgaaaccgtgatgccattttcaaatcgcatataaacgtagttaggagtcatatactgttcaatttcgcatactgatccattttgatgtttccaaaggcagatggtatcaatagaacctgtaataccattagaaacatatttacgttcaaagttaatgtagttcattttattctccaagatgtttaattgcggtacaggtatataatatcatgtcatgtaccaaagtaaacaattattttactactttccaatactgcatgtcaagtttaccgacttttttcatcttctcaattaagcgttcggcacgttggcgagctgtaacataataccattcacctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagttttaactgcagcgttcagattaatcgttttcattttattctcctttgtttgtgtaagataatactatcacaaaggaaccatactgtaaacaactttatgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcgacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggtttttggatatttaacgaccaggataaccataaacccgtcatcataccttatagctcttatctgttgcacaccgttagcttaaaggttccgggttcgatttctcgaggataagatatatactgatggatatataggccttgaggcgtactcccgattggccatcacctcggggtagcatgcacttgccgctataagaataacattcaagaggtacaccgtaaaactgccggggtcttaaaactataatgattcgcaaatcattaatcagacagttcgacggctcctcgattttagctcacactaaggcagtgaatctccaataaattacttcaatgttaccacaaagtgacgaactgcttttcgcgcagcagaagccaaaggcttagcatatttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaagtaacgaatttttgtttaatttcttttggctgcttaagacccagagctacaaaaggatgcggaacatttcgaatttgaccaactggaagagaagtcaaatcaccaacttcgcagaaaccttcaggaacatcaggaccgacagagtgaactacacacagttcaggaacttcaccttgaacacgtttaccgataataagtcctgattctgtaacttcttcatcaccggcttgtgcaggttcagaaactaaaataacatattcaccgacagcacgaattggtagctgttgtacttcagacatcgtttttcctttttgttaacagatgaattaataataacaaataattcttaaagcatttatttaccaataaattggagcaaatgctcaactttcataccattaacggaaatcaatttgtcaatagaaaaacctcgccatgcaccaagttcaacatcaaatactggaatcatatcagtagattctttccgagtagattcagtcaatttaccagtttgcatggttggcataaagtcagcatcgcgagtacctttcataacacgaatagtaccatcagacttttcaaaaactacgtttgaaacacccatggacaatttagttttcaaaatttcacgaattgctactttttgttcagtcgtcagtttcatttatttacctattacagttttaatatgagttgttccacgttctttaagagtggaaagtaatttttggcatttttctaaatcagatttccaactatgtggtctatcaatacaaacccagtttgacttataatactgcttccatttagagaaaaaatacttcttatactctacagcaaatgaaatgttctcgttggaataagaactaattgctgtgagctgtaccaaacgaaatttcattattcaccgcagaattcgttgatattttcccagtttaacttattcaagtttttcttaggaacattaaacacttcaatacctgcatttcgcagaatatcatcccagccaggtttatttttatcgtatgtttcgcaataaaccagttttttaattccagactgagctatcgcttttgcgcaatccggacaaggagaaagtgttacatacatagtagcaccttcaattgaagaaccatttcgtgcagcaaacaaaatcgcatttagttcagcatgaatttcatttttagacgaccattcagagtgcgcgctacgatgttctttcgccaatacaaaacgatcagttgaaccaaacgatacacattcaggcttatgaccttgaatgatagtatgtttaggcttattcagcaaccaaccttgctcagcagcataatcacagcagttcacaccacctgcaggtgaaccattatatccagtagaaataatacgtccattcttttcaattactgctcctactttccaggagcaacattttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcgccaaccatctttttgtgaagctcaaccggatacttcgtcacaataatagcatcatacacagaaggatgaatactattcaccagagtatcattcattaaagttattctaatgaactttgctgtttcagagtcaagcgctctatgatcgccagtatcattttcaagacaattatcaattatatcagttaaattcatcatagtacgccatacaccctttgtgcttcaactaatccatcaaaatccaatttgagatgtgttatttggtcaccatcacctggattcacaattactaataccgaacgaggagtttcggtaataacacgaaccgacgtttcaggaaatcgttcagaaaccttatttaccaattcttgagcaaatagtttaactttttcttggaattctttaacagtaattggtttttcgcttagcatgttgatcctagctccttactttcaacatttttaactaatttgacagaaactaattcagcatcttgggtaatcattaccggaccttcttcatgctcttcaagatattctagagctttctttttagcttcttccttcgtatcagtttgagcatagatatagaacatacaaccagtaatacctactactttccacttaatttctttatcagttttaatttcaaatttacttacagaatcatctttttgaacttcttcgaaaaaagaatattctaacatataagcaattgaaaataacgggctaactttataggattcacccattacatcaacagctttataccaacaatcatcaatttcacgtttaatgctaataacatttttcgcaggatctatttttactttaaatgaattttccccaataaactgggcaattcgtttattagccccgcaagtttcattaaaaatatctttatacccagttttaaagcgataaaccttatcttcttcaaaccattcgctcatttcaatttcctcgtttgttttggtagagctataatatcacaactctaccgtaaagtaaactttaaattgctttgaattctgatgtctgtgattcaaagcgaatatcgcctttgatgactagctcagcatcaagaccgaatacgacaatgatatgcgcggaacctggatacaacgtgatggcaacagaatccacctggtctggaagcaaagtgttcaatacatgagtcacttgagcatggattcgaagctcagctgcgttatcaagtttttcaaacatattattagcgataatttggctaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccaactaaaccgctatttacaataacaatagcccaagtttcatggtgccaagccattaaaaatctcccgaagcgacttgccagcattcaacaccgatgcggcgccacatttcaactacttgagttcggtcatcaatagctaatttcacatcaaaatgcggtgcgatgtgtttccagaaaatttcttctttaactacatcatctttacgggtatcgccttgttcgcgttgacactgcatgactaatggaacaccagcaatgtcctcaacccatttacgggtcatacgataatatttcgttggatcttcttcggttccactttcacggcctgaaacgactacgatttgataacccataagagcatacatcttggatagttcaacgaccattggattaataatatcggtatcgcatttttcaaggtcataaggaccacgaccattcatttttgctaacgtgccatcaacatcaaaaataactgcttttggtttaccaggagtccctttatataccggaagaccgagatactctcgcatgcttttatacattgaacgtaaaacatcaattggtactgctttagttccgcgttttgagttgcgtttaaccaattcagtccaaggaacatcaaacactttatgttcaatttgatgcccaagctctttggcaaactcttcccaaaccttacgtcgttcaggattcagattagtatctgaaacaattacacccttcgttgcgtcttggcagagaatcatgttagcaacatcatgctgcatgtaagttacgataccttctttatttttggtatacttgtactcatcgcgttcttcatgtgccataatagattggcgatagtcatcacgattgatattataaaaccctggatttttagcaataaattcacgagcccaagtactcttaccagaaccaggacagccaatagtcaaaataatctttttcatcatttaattcctaagaaaacttcaagaatacgaatattgtgctcacgccgtcctttgtacaattcagctgttgattgattcgctgatttactctgaacattggatgaaataaattttatcatgtgatttttaagctgatacatatcaagcccacgagctttcgcttcttttcgcagggctttaccagcatcatctaaagctttagcagggtcttcatcatttaatactattccacgatccaaatccatgtatactgcaccatgacatgcatcaatgtaaaggtctgagcattcaatataacgttctagcagagttttcatttatttttctcaactaatgattgaatataatcatgcaggtctttagatgctttaccccacttattttgatattcatttttgagattagcacgggattgagctaataaaacatcattagttggaggtaaagattctaaccgctgaatctggcgtccataaatcattgcagccatctcggattcataaatcaatcctttgagatgttcaaattgatgccatgaaatcatttacatttatcctcttttaactcttgacgataataacatatcatagttttttggtcatgtacatatcgttttacatcattaagccaaatacgaaattcctgggaatcttcaaatggcataccgacccaagctttaccatcaataactttaacttgccaagatagtttagcttcatcatatgactttatctgtacaggccaattaggatgaactgtttctttctttacttctagaggctttgtcgaacaaccagctagaagaccgatagataatattactgctgatagtctaatcatttagaaaggtcctggatgtcttctgcgaacttgttgaaggagttgttgatttgtttttcaaccaatcctggcttacgagccaccacatccgccttctttgcatctttgcgcagtttttcattttcacgctcaatagcagcaatcgcctcacgatttttattattcatcgcatcaatataattatactgaattcgcaaattatttaatgctaaggcgttttcattggccgtttttgtaatttctacaacagacgtttctaatctttcaattttattttttaaaattaaagaagttccgcctaatgcaattacaattaatagcaaacctgctgtcgtattacttaattgcataaagttttaataacctctataatatcgtcttgagaaagaccgttaattaaaatatgatgttcagccggagatttagaaattttaaagcacgccgcaacatcttctgccatatccgatgcgctacgatttggattactaattccaagacgatgttttcccgttaaaggattaacgatgatatagcatttacagttgttaatatgaacattaggttgagtctgattaatgaacacatcgcaatcatatttcgcaagctgattttctaaaaagactttcatctcttcaaccgcatcaggaagcatatcacgggcttgctcaagacgacgatttcgatattctttaatggtcgttttccgcttgacttgcttagctaaatctttcttaagatcggtgatatatccaactcgacgatttcctttaaatacagaaatcccatctgtagtatcaccgtatgcttcaacgaccatttcagtagtaataagctgcaaatccatcataaagtcctcatgttatgtcagtaagactactataacacaacacgagggacttgtaaacagcttagtatccttctgggataaattttttataatttttcaaaaaattctgttcgatttcgcacatgaccttttcttgactatcgtacccctgatataggctcataatgataccgaacaggtgatccattccagcacctttagcaacgccttgcgcttccatcgcataagtctttctatctttaccgcaatgcttattgtgacagtcaagaactaaaaacagagctcggtctaagtacttcagataagtcgtctcaaatgcttcaatttttctatatgaatattcatcgtcagcgtacattgctttaagatcatctgatgcaccatcaataatagtcttaaacaatttttctggattatctaatgaactttttgtactatgaagagacacgtaccaatcagacttaattttaaaatgagaaccatctttcatcacggcaacatagccttcgatgttttctgcatttttagcttcttctacccatttaggactatcgatttcgtatcgttcaactagatatggacgaagaatagcatctttataaatatcatcatatgaaatgtattcgcctgtttcattttcacgaatattcaataagatgattttcatctcttgataagcaagaacgattctattcgtcggagcaacgaattcgaagttagcagtaaatccatcttcggctaattctttaagtctgtcgcgcaactggtgatgattaatattcatcaaaattccattagccattaaagcctgttcggatttgattgaaccctttgatttgaacagaatttcatcaccgtctaaataagttgataccaaagacccatcttcttttgttagaatgtaatcaacatcatttaaatcgatattcatcgtgaatggattttcattcaagttaaaaaacttttccataggacgagaagcgattcttaccggtttttctccatccatttcaaacataattccacgacattccagtgcatctggaagtaaccaatcagaataagatgcataattatatgagaaaattctataagttcttccagatgcacttacatcatccgagtaaaaaaacttacgctgtgaatccttacatagttccattaaattgttaaaaagttcttgcattgtgtatcctcttttgtgttttgaatatagtaccacattccatgtggaagcatcattttttcttgtgttgaatattccaaggcgggttaaacagtttaatgaatagcggctcctctaggtcaatcgttgcgattgtcattgtacctaactcatttgtcatagaaagattaaaacattggcgggcgtaaaattcaactttgcttccttcctttagcgcagaatgaattaatgcagatttagtagaatcagacgttttgtctttacgattaatagcagttctataatagtttattcttttacgtaaatttttagtttttccaatataaacaagctcatcatttatagcaatagcataaattacgttatacttgtttggaatagataattgttttatacttccgttgtcgtctaattctagctcagtatatttaataaatgaatattctgttgcaatttctttcataataaaatgggccttgcggcccactccttaaaagtattttttaaaactcatcataactttatcatcaacatcattatcaatctgtgcaacaaggtaagatgacaattctacttcttgtggcgcagattgaacattatcagaattaagatattcacgaatccaaggatatggatgtttaaccggagcatcggtaattgggcatggaagaccacactgcttcatacgagatacagttaagtaatcaataaagctccacatgctatttgtatttaatccaggaacatctccatctttaaataaatgaactgcccaatctttttcttggcggttaacttccatgaaaatatcaactgcttcttgttcacactcttgagcaattttaacccattgatcgccatcagtaccagattgaagttgacgaataatatattgggtgcctttaaggtgaagctgttcatcgcgtgcaatgaacttcataatcttggcattaccttccatgatttccatgttcttatggaagttaaaggtacatgcaaaagatacataaaaacgaatagcttccaatgcgttgattacatgcaaacagaggtaaagagatttcattagctcacgcttccaatatgtctcatgctcaatagcatcttcaataacgtcttcgtctgcattaatttctttttggtattcgatatcagctttagcgttttcccaataacgagttttaatcagaacatcatcataataacgtccaatggattcagcacgtttcataatagcttcatctaatacaatctcatcaaataccttcgatggatcagtataaagatttcgcatgatatgagtatatgaacgactgtgaatagtttcactaaaagtccatgtagcaacccatgtatcaagacttgggtctgaaattaatgacataagtacagcagacggcgcacgaccctgaatgctatctaaaagtgattgatacttcaggttgttagtaaaaatattttgctggtactgaggaagcttattaaactgtgcagcatccatcatcaagtttacttcttcaggacgccagaaaaatgataattgcttttcggttaaatcttcaaaaactttatgacgttgaatatcataacgcgcaataccaagacctgaaccaaaaaacataggttcttttaaaacatcaactggatttgtattaaaaactgtagacattaatttttcctctttaaaattctgccgcgtttccaacctggcggtataatatcatctttacctataagcgtgcattcacttccattattaatccatttcttaccacggattcctttataatctcttggttgtattttgtcaaactttgcatcaagttgatatgcccatctaaatccataggcatattgaaatttgccctcagcgcaatatttgatatttgacccgtttccattaactgacctggacgctgccgcaatagagtgaaaggtttctatgaaatccccatctaatgagaatttatgtatttcgatagatgggcatgcatacctattcacgtttgatacatgttgtttagtttcgtttttatgatgcttgcctaacattcctctaggatgaggattatttttccaatatttcttaaagaaatcagaattagctttagcaaataattttctgtgcaagctatacaatctgttattaattctattaccagctttatctgttgccattaacgttaacgcagaggcaagcccaaaatggccttcatttatcttacatagtaatagatgcgctataaaatgttctctagctgttaattcaactaaattttctttatcatcagaacctcccatgcatttagggactatatgatgtgtctctttatattcggataaaggttcccgagcctgagctcgggaaattaggtcgttatagattttttgataattcattacaatttacacgctgcacaatcgtcggctttaggagtttcgatttcataatcatcagtaccagaaccatcgcgggtattatgataatagaaatttttaatgccataataccatccgtatagcatatcatcaatcattattgacattggaacctttccttttggaaaaatctgcgggtcataatatgtattcgccgaagctgattgacaaacccatttcagcataatagctacctgcgtaagataaggtttattacctttcttagctaatttccatgtatagtcgtaaaggtctatgttatgctcaatattgggcacgacttgattaaaggaaccctcttttgattctttaacagagactggtccacgtggaggctcgataccgtttgtactgttagaaacttgggaagatgactcacatggcataagtgctgataatgtgctattacggatgccaaagagcttaaggtcttcccgcagcgccgaccagtcacaaacgtattttggagctgcgatttggtcaatctttttattgtaccagtcgataggtaattcgcctcgagaccaacgagtgtctgaataatattcgcaaggtcctttttctttggcgagcttaatggatgctttaatgagtccatactgtaatctctcaaatagttcatgtgttaaatcattagcatcttcataagaagcaaagttacttgccagccaagctgcatagttggtaacacctacaccgaggttacgacgctttttagctttttctgcttcaggaactggatatccttggtaatccaacagattatcaagagcacgaacttgaacttctgccaattcattaattttatcttggtcttgccagtcaaaattatctagtacgaatgcagagagagtacacaatccaatttcagcatcaggactattcacatcatttgttggaatagcaatttcacagcacaagttactctgacgaataggtgccttttcacgaataaacggagtatagttattcgtattatcaatgaactgtacataaattcttgctgttcctgagcgttcagtcatgagcaattcaaatagttcacgggctttaatacgctttttacgaatattagggtctttttctgctgcttcgtataattcacggaaacggtcttggtctttaaaataagaataataaagctctccgcccatttcatggggactgaacaaagtaatgtaatcgttctttccaaaacgttccatcatcaaatcattcagttgaacaccataatccatatgacgaatgcggttttcttctacgcctttgttatttttcaaaacaagaagattttcaacttccaaatgccaaataggataataagcagtagcagcgccgccacgaattccaccctgtgagcatgatttaacagcagtctgaaaatgtttccaaaaaggaataacaccagtatggcgtacttcacccatgccaatcttagaaccttcagcacgaatcataccaacgttaataccaattccagcgcgtttagagatatattcaacaattgaagcagaagccttattgatagacttcagtgaatcgcctgcctcaataacaacgcatgaactaaactgccgagttggagtacggcaaccagccataataggagttggtaatgaaatctgtcgagtagataccgcttcataaaaacggataacatgttttaatctatcaacaggttcatcttgatgcaatgccattccaatagtcataaatgcaaactgtggagtttcataaatttgaccagtggttttatctttaactagatatttttcttttaattgcatcgccccggaataagtaaattccatatcccgctcgtgcttaatttttgattctaaaaatgtaatttcttctgctgaatattttgacaataattcagggtcatatttaccttcatttacacagtaagaaatatggtcaataaatgaacgtggttcatactgcccataaacatgcttacgaagagcgaacattaaacagcgtgcagctacatattgataatcaggctcttcaaccgaaatagaattcgcagcagccttaatgacaatagtctgaatgtcatcagttgtcattccatcacggagatatgatttaatattttcatataattcataaggatctactgatgttccctcagatgcccaagataaaactttaataattttttgcgggtcaaagctctgagaaacaccactacttttgataacattaattaattgcataagtcctcaacttgaaaatcgtctttaaacagtcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattcacatcaaagtcggatttgtatttattcactacccgacatagacggcccgcgcggtgataattcgtcatattgtttttccgttaaaacagtaatatcatagtaacaatcggaagaagttttaactgtggaaattttattatcaaaatactcacgagtcattttatgagtataatattttttgccataaatgataataggctgatttggtcctggaacttctaactcacttgggttaggaagtgtaaaaagaactacaccagaagtatctttaaatcgtaaaatcataaatcctcacaattaaattaaaattacaccgccatttttcctttcaagacgccgtgggactgataatctttgagaacgaaatctttaggcctgagtttaagaatgtattccaattgttctttagtagaaagatagcggaatttataaggcaatccgcctattaccagttcacaaagctctttaggttcacgacgcaaaatttctttacattgttctacgtgattcatatagatatgagtattaccaccggaaaatatcaaatctcccggaataagattacacatcttagctacaatatgaactaacgtagcatatgatgcaatattaaatggaagcattatgttcagataaggtcgttaatcttaccccggaattatatccagctgcatgtcaccatgcagatcagactatatctccaacttgttaaagcaagttgtctatcgtttcgagtcacttgaccctactccccaaagggatagtcgttaggcatttatgtagaaccaattccatttatcagattttacacgataagtaactaatccagacgaaattttaaaatgtctagctgcatctgctgcacaatcaaaaataaccccatcacatgaaatctttttaatattactaggctttttacctttcatcttttctgatattttagatttagttatgtctgaatgcttatgattaaagaatgaattattttcacctgaacgatttctgcatttactacaagtataagcagaagtttgtatgcgaacaccgcacttacaaaacttatgggtttctggattccaacgcccgtttttacttccgggtttactgtaaagagctttccgaccatcaggtccaagtttaagcatcttagctttaacagtttcagaacgtttcttaataatttcttcttttaatggatgcgtagaacatgtatcaccaaacgttgcatcagcaatattgtatccattaattttagaattaagctctttaatccaaaaattttctcgttcaataatcaaatctttctcatatggaatttcttccaaaatagaacattcaaacacattaccatgtttgttaaaagacctctgaagctttatagaagaatggcatcctttttctaaatctttaaaatgcctcttccatctcttttcaaaatctttagcacttcctacatatactttattgtttaaagtatttttaatctgataaattccgcttttcataaatacctctttaaatatagaagtatttattaaagggcagtcctacaatttagcacgggattgtctactagagaggttccccgtttagatagattacaagtataagtcaccttatactcaggcctcaattaacccaagaaaacatctactgatcgttgataccactgcaaatccaaatagccattacgcacattaaactgatagaacatatgacaaggaggtaatgccatttgcttaagttctgccggattccatgctgaaacaatttgacgcctatcatttggcagttttttaatacgatcaataacttctataatttggtctacaccgccaaaatcacgccattgttttccataaattggaccaagttcaccgctatggtatcctaaatcttttgcttgattttcgtaattttcatcccagactgttttgccttgaattaatgaattatgttgaattaatcgcaaatcatttacgttagtacttcctgataagaaccacaataactcagaaatacatgcattccaggcgagcttcttagttgttactgcaggaaaacctttagttaaatcccagcgtaatttagtaccgaacaaagcaattgttcctgtgcccgttcggtcatcagtttcataaccattttcaaaaatgtctttaattaaatcttggtattgtttcatttagtaccttatataaattataatacattttatgaagctaaataatcaatacggtttagcatcaaattttctctcaatttcaggcgtgaaatataattctttaccgcgtttggaaaagcgaccaataatatgataattattctcatcaaacgtgatattaccaatatccatagctttcaaccaaatatcgatatttctatccagctttatgtcaaaattccaatacggagaactattaccgaaaatactgcaagcggattcagtgaaacaactgctataaatcttgtctttaggaactactaattgatagacacctttaataaactgaggaccctgccactttggctgtttcgcgtcttcttctaatagaatagggtaataattaaaattcatattttccgccacgtgttatttcatttatatactgattccgtaagggttgttacttcatctattttataccaatgcgtttcaaccatttcacgcttgcttatatcatcaagaaaacttgcgtctaattgaaccgttgaattaacacgatgccttttaacaatgcgggaaacaactacttcatccgcataaggtaacgcagcatataacagagcaggcccgccaattacacttactttggaattctgatcaagcatagtctcgaatggtgcattaggacttgaaacttgaatttcgccgccagaaatgtaagttatatattgctcccaagtaatatagaaatgtgctaaatcgccgtctttagttacaggataatcacgcgcaaggtcacgcactacaatatgactacgaccaggaagtaatgtagataatgactggaacgttttagcacccataatcataattgtaccttcggtacgagctttaaaattctggaggtcctttttaactcgtccccatggtaaaccatcacctaaaccaaatgctaattcgtcaaagccttcaactgttttagttggagaataagcgaataccaatttaatcattacgcaaatcctctttcgataaaccattcagtggctttattagcatcaaagaataattcttcatacgtcttttctttgttttcaaaaactgtcacacaaacacgttgacattctccacagtattcttctgacatactcaaagcatcagaaaacatttcattaaattcacttaaatcaggattatgcaatgcgttaaaaattgcataatcaaattcatcattcataaattcaaatacaaaaatcatattatctcctattaaaaaggatcaagaacatatccgctagctttaatcattttaattaacgttaacattcctttgttaactgctcgtgagatttcatcaaaaacttcatcactaaaaagttctaacacgcccttctgaacttttaatttacagccaacaatttcttcatcgcctacagtaaattcattaccaccaattccaccgaaaaacttaattacaccagttaactgtcttccacgagaatatgggtcgtgtgataaagtaatatgagtcaccccgggtacagttttaaattggcagcgaatatttacttgtgaaattccagttacatgaatgtcagacataatattttcctcaaatagactttttcacaattttccaatcagctttaaactgatcgacgtcagagtgataaatccaaaatcctgcgctttcaccgtcttcataaagcggacacccatcacattcatcttcccatcccatgccacgtaaaaggcgttcagctttttcaacaagttcagaatctttaccgatgatattaaaataccatttacctctaacttctgaatctttgatactctgacgttgtaatctcattttattctccttagcaagctttaatcaaaagatataaacagaccaacataactgctgccataatataaggtgcgaacattttcttttctccattagttttgatagggtaatagtatcacactactacccttttgtaaactactttttgaaagtttttcgcaaaagttcaatgatttcatctacattgttttcgtcaacaatgcagtgaatttttgttacgccagaaactatgtcttcggctccatcttcttcagaagtcggttctttatactcacgaaaacaatgaaattcgtcttcacaaacgttaaagtaaaaatgctttccatttgcgcattcaatgtgttttattactctaaatccatcaacaaagaaagcttctttaacttcaaaccatccaccattttcttgaataattttaactatcgatgaattagaacgtgggcgataattaataaatgtatcaataagtcttggaacaagctcatactttttgccaatatacattacgttttcctcattttaacggggcttgtaatagccccttgataattattgttcaatcaatcccatgtaaaattctgcgtcttcagaatccataccatcacaatattcattagccataaagcgggtgaggtcttcaagaggaccttcaatgacaatagaaaaattgcaataattgggatcatcgtgaatacttgtgatactaagttcaggataacgattacgaataatttcttcaatatattcaaaatcaacgatgtcaatatcaactttagccatattattttcctctttaatcatcagcagtattgccgatagttgtatagtaccatggaaggacaaggatgtaaaccgttttgtgaaaaaatttttgaaataaaaaaggggacctctagggtccccaattaattagtaatataatctattaaaggtcattcaaaaggtcatccaggtctgtgtcatcagcactagatgaactgccagagcttgagctcataaaatcatcttcagtttttgttttgaagtcatcaacattgaatgcatccaaatcatcagcaactttatcagctttcttagcggcagttgcagcggcaccacccattgcagcagttcccataacttgactgaacttagtgctcagttcttcaaatgatttgaatttatctttagaagtcatttcagaaaggtcaaccatttgttcgaacagttctttctggaaagattcatcgtcaatgtttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttacaacaagaatattagcccagtaagaagttttacgtttaacaagactgtactctttattgtcagtgttgtacagatcatttttactgatgtactgacatactggacaagaatcgtaatcaccgtgggtagatgaacagttttcaatataccatttaccatttttcttgaaaccgtgatttacaagaattgcgaatggtgcttgttcatcatttttagacggaagaaaacgaattactgcttgaccgttacccgcattgtcgagtttcagtttccactcgcctttatcttcagaagaaaaaccacctttatttccagccagtttagccatttgtgcagcgagttcagcagtagatttacgtttaaacatttttatttcctttttaatttaattaacagttggtgctatgacgatgtatgacctcatagctggtcagtgagataattataatctatttataataagcaattaatacttgcaagatttcacagtttcaatgaaaacatttttagctttctgtgaatcaatatttaaaatttttctataagcctttaactttatagaataattattccagactaaattatcagtctgttcatcatgtttatcaattatatttaaaaacgaatcaagcaagataaacgtctcaaacgaaattatgttcgattgcagaagtttaaaaatataacttgactgaacctttggattatattcaaagatttctttaaaagcagaaacttcaactttcttactaaaataataaatgttgcgaatatcttcttcaaacttaaatttaatttgctttaagcgtccgatatattcacgataaaacacaagtgcatcagcgtcagagatgtcaccaatccaagcatcttggttagcaaccaaattacttataaagattaaagcaagttcctttaatttatatttttctgataacttctggaaaaaatacttatcccttcgcttttgataagcggcatcagacacccgcatgcaccaattatacttaataacatcatactttccattcatatgttgttttatcattaagtataatttataaactgatttaccatcaatgtatctttcaccaccagcaggcatgcggagtttaatcatagtagaaaatctaatgtattagttttttcacaacgaacaacagaaggacgtaaaagattttcgtcaatggcttctgactgaattttttcaattatacccgaaggaataaatttagcaaattgagtttcaggaatagagttttcttctaagaatgctgttgtagcttcaagataactcattccaaactcttctaccattttttcaataataaatccattttcttgacgatcaagaagctttgctatttcatccttttctttcttgattgaaagttctttttctgaaagaccggtctcatcgaccggacgaatgtcatttagagaaaactgtgtcataaagttcaactacctcttcagtttcagcttcaaacacatcacggttatctttatgatacaaagctaatagacgattaaacatcttaccatcaacgccaagttcatctttggcacgaattcgaatatctttaatcaattcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatactcagattctgagagaagcaccttagcttgctcacggtcattagcaatagcttcaacgattgaagttttcattgaaggagttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttatgcatcggtgaccattgcttaacatttggatatttgtgaagttgagtaaagtcaccgtccgatgaaatgattaaaatcttatgtccttctaaagagaactttttaacaagaacagcaatgtggtcatctgcttcatacttatcaatatccataacaatgtatggcatataagctttcaattcatctataactttatgactggattcaaaataaccttcccagtcccaagtagattcttctcgtgcttttccacggtttttcttataataataagcgaaatcacgacgccagtatccagatttcgcgttatcaatacacagtacaattttagtgtatccaagcgtttttgcttttttgacattaaacttaattgagttcaatatcaaatgacgaaccattgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttgggcagcaacggataatattccaaaacctgctggaaattttaatagaattcgttggaaagcattacgtactgatgccgtatatacaactgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatgatattcatttttaataatcgtttgtggcaaatgtatgttgctgattatagcagagaagctgcgattgttactccatcgactgcgtatcaagcacaatctaatgattttatcgtatgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaaggccgtacatcgattgacggtttcttgatgtttgacgataatgagaaattgtggagattgtttgacggggatagtaaagcacgtttacgcattataacaactaattcaaatattcgtccaaatgaagaagtcatggtatttggcgcgaataatggaacaacccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaacggtgaaactaattatgtaccagttttgcaacttgcttatatagaagattctgatggaaaatactgggttgtacagcaaaacgttccaacagttgaaagagtcgattctttaaatgcttctactagagcaagattaggcgtaattgctttagctacacaagctcaagcaaatgctgatttagaaaattctccgcaaaaagaattggcaattactccagaaacgttagctaatcgtactgctacagaaactcgcagaggtattgcaagaatagcaactactgctcaagtgaatcagaacaccacattctcttttgcagatgaccttatcatcactcctaaaaagctgaatgaaagaactgctacagaaactcgcagaggtgttgctgaaattgctacgcagcaagaaactaatacaggaaccgatgatactacaatcatcactcctaaaaagcttcaagctcgacaaggttctgaatcattatctggtattgtaacttttgtatctactgcaggtgctactccagcttctagccgtgaattaaatggtacgaacgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacgccagaaacgttacataaaaagacatcaactgatggaagaattggtttaattgaaattgctacacaaagtgaagttaatacaggaactgattatactcgtgcagtcactcctaaaactttaaatgaccgtagagcaactgaaagtttaagtggtatagctgaaattgctacacaggttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttgataactcctaaaaagcttttaggtactaaatctactgaagcacaggaaggtgtcattaaagttgcaactcagtctgaaactgtggctggaacgtcagcaaatactgctgtatctccaaaaaatttaaaatggattgtgcagagtgaacctacttgggcagctactactgcaataagaggttttgttaaaacttcatctggttcaattacattcgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgagtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattaacggaaattatggtttcattgttcgcaatgatgggtcagtaacgaattttatgcttactgcatcgggtgatcaaactggcggatttaatggattgcgtcctttagctattaataatgcatctggccaagtaacgattggtgaaagcttaatcattgcaaaaggtgctactataagttcgggtggtttgactgttaactcgagaattcgttctcagggtactaaaacctctgatttatatacccgtgcgccaacatctgatacagtaggattctggtcaatcgatattaatgattcagccacttataaccagttcccgggttattttaaaatggttgaaaaaactaatgaagtgactggacttccatacttagaacgtggtgaagaagttaaatctcctggtacattgactcagtttggtaacacacttgattcactttaccaagattggattacttatccaacgaccccagaagcacgtaccactcgctggacacgtacatggcagaaaaccaaaaactcttggtcaagttttgttcaggtatttgacggaggtaaccctcctcaaccttcagatataggagcgatcccatctgataatggaataataggtaatcttactattcgcgatttcttgcgaattggtaatgttcgcattattcctgacccagtgaataaaactgttaaatttgagtggattgaataagaggtattatggaaaaatttatggcagagtttggacaaggatatgtccaaacgccatttttatcggaaagcaattcagtaagatataaaataagcatagcgggttcttgcccgctttctactgcggggccatatgttaaatttcaggataatcccgttggaaatcaaacatttagtgcaggtcttcatttaagagtttttgacccttctacaggagcattagttgatagtaagtcatatgctttttctacttcaaataatactacatcagctgcttttgttagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtatcatatgctgctttttatacttcttctaaaagagctattgcattagagcatgttaaactaagtaatagaaaaagcacagatgattatcaaactattttagatgttgtatttgatagtttagaagacgtcggagcgacaggatttccaaaaagaacttatgaaagtgtcgagcaattcatgtcagcagttggtggaactaataacgaaattgcgcgattgccaacttcagctgctataagtaaactttctgactataatttaattcctggtgatgttctttatcttaaagcacagttatatgctgatgctgatttacttgatcttggaactacaaacatatccattcgtttttatgatgcatcaaatggatatatttcctcgacccaagctgagtttactgggcaagctgggtcttgggaattaaaagaagactatgtagttgttccagaaaacgccgtaggatttacgatatatgcacaaagaactgctcaagcaggtcaaggcggcatgagaaatttaagtttttctgaagtatcaagaaatggcggcatttcaaaacctgccgaatttggcgtcaacggtattcgcgttaattatgtctgtgaatcggcttcacctccagatataatggtacttcctacacaagcctcttctaaaactggcaaagtgtttggacaggaatttagagaagtttaaactgagggagccttcgggttccctttttctttataaataatattaaaataaaggggcatataatggctgatttaaaagtaggttcaactgtgggtggatctgtcatttggcatcaaggaaattttccattgaattcagccggtgacgatgtactctacaaatcatttaaaatatattcagaatataataaaccgcaggcagctgataacgatttcgtttctaaagctaatggtggtacttacgccggtccaattactattaattacggggtaaatagttatcttcaattaagtaataatgaaacccctatccgaattcgttctggtggcggcactggtaatactcttgtagttggtggctcttctggcggtattagttttagaccagcaggtagtgaaatcactactggacaaattactattacgccagaaggtttgacaacatttaccaaagctgtaacggctccatctgtaactgttacatctactccttccgcagcatctgatgttactcgcaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaactgcaggtcaacgtcctgctgcttcagtattagccgaaggtgaattggctataaacttaaaagataaaacaattttcacaaaagatgactcaggtagtgttatagaattaggtttaaaatatggaggaacaattgatggttctttaactgttaatggaaacataattggaaatttaacaggtaacgctgcaactgcaacgaaattaaaaacagcacgaaaaattaatggtatatcctttgatgggtcaaaagatatcacgctaactccatctgacataaatgtcaatagcacaacgtttataaaaaataacggcgaattacctgttgatgctaatttagatgagtatgggcctgttgaagaatatcttggagtttggtcgaaagcaacttcaaccaacgctcaaccagcaaataaatttccagaagaaaatgctgtaggtgttctagaagtatttgtggccggtcaatttgctggtactcagagatatacaactagatacggaaatgtttatattcgttccttgactgctacatggaacggagtaaacggtccgtggagtgcgtggcgaaatattcaatctggtactcgtccactgtcaacaacgattgatcttaatgatctaggaggcgctgaacaccttggtttgtggcgaaatagttcaaattccattgctacctttgacagaaatttcccagaagaaggatcgtcagctcaaggacttttagaagtatatgaaggtggaaactattctcgcacacagagatatacgaccagatttggtgttgtttatactcgctgtcttgctgctgcatgggatgcatctgcacctaaatggggaccgtggcaacaagtcggtaatgtcacaccggcgactttctatgacggagacctgaatgattttaaagctcctgggttatataacattttaggcactgatgccgttattaactgtcctaccggtgaaggtttgccgactgttattgttggtttgctggaagttaaacagcgtgcttctggcggtgctattttccaaaaatttactactgccggaacgggtgcaactactcgcgatcgtatttttgagcgtgcatatactggtggtgtgtggggtgcatggaacgaagtatatacatcttattccctgccaattactttgggtatgggtggtattaaatctaacttagcagagttagactggcaaacatttgattttgttcctggtagtatgtttagcgttcctttgaacaaaataaagaatatgccagcaaatatggattggggcacgattgatggaaacctggttatgttttctgtcggtcctagcgaacacactagcacaggacgtactgttcaggtttggcgtggtactgtatcccagacaaactaccgttattttgtcgttcgtgtgttcggtaattctggaaatagaacttgcacagtccgccgtgttgttcttgaagatggtcgccacacatggacagctcaacaagattttaatggtgctgttaacttcggtgctcctaccaattttaactctactgttaaccttaataacactaccacatttaaaacagaagttaaattccgctcgtcgactgcattccgtatgtatggcggaaaatttggtacatttttacgtaatgatggagagagtctttatattctttccaccgacgaagatgatcaagatggaaactttaatacaaatagacctttccgttatgaattaagaactggtgatgttactttaggtggtactagtggtgctaacgttttaaaattaaaacgtgattctctcaccgcattttttggtggtgatattaacatgaaaggcttgatgacttttgacgccggacgtttaggatcacgagattattttaaatttaaccattggggtgatagcaataacgctcgtgataacattattcagttagaagacagcaaaggcgctcatttttccactgaacgtactttagcgactggtgcaattaagactaaattttttggtgaaattgaatccgatggtaaattggttattaaacgtccgggtgattctattgtattatcagcacctgctagtaattctttgcatattcgtggtgacgtagacgggactggtaactggtatattggtaagggtggtgatgataatggattagcgttctatagttatgctactaatgctggtgtatacattacaaacgcaggggatatcacgctaagtccaaaaggcgtcgaaatggctcaggtcaataacgttcgattatatgttcatggtgaacgttggaccgctagtcaaccgggtgattggggcaaccaatggcgagtagaagctccattattcgtcgatcatggttatgtttcacaggattgttattatccaattattaaaggaaaaagtgtaatcaccaatcaagggtttgtaactgccgtcgatcttggtattcgtcgtgtccctaacaattgggggcaagcaattattcgtgttggatctgcagaggcatcgccagcggctggacaccctaacgcggtatttgaatttcattacgacggtactttctattctcctggtaatggtaactttaacgatgtgtatattcgttccgatggtcgtcttaagattaataaaaaagagctagaaaacggagcacttgaaaaagtatgccgactgaaagtttatatttacgataaggttaagtctattaaagaccgtagtgttattaaacgcgaagttggtattattgctcaggaccttgaaaaggaattaccggaagctgtgtctaaagttgaagttgatggttctgatgttctgacaatttctaactccgctgtaaatgctcttttaattaaggctatccaagaaatgagcgaagaaattaaagaattaaaaacgcctttcttcactaaaattgctcgcaaaattagtaattattttaaattctaacaacaaggggctttgcccctttggagataattatggcagtagttggtgttcccggttggattggaagttcatccgtaaatgaaacgggtcagcgctggatgagtcaagcggctggtcaattaagattgggtgttccttgctggatgagtcaatttgcaggtcgctcacgagaaattattcacacgcttggagcagaccataacttcaatggtcaatggttccgagatagatgttttgaggcaggtaatgcacctatagtgtttaatattacaggtgatttagtatcatattctaaagatgttcctttattcttcatgtacggagatacaccaaatgaatatgttcagttaaatattattggcgctcatatgtggggtagaggtggacaaggtggatggactcattccggtggagatggtaatggacaacaaggcgggcattgtattcaaaacgacattggtggacgattaagaattaacaatggtggagtaatctgtggtggcggaggcggtggtggcggcattgcttaccgtgttcactcaggggcagactggcaagatattggtggtggcggcggaagaccatttggcccaggtggtggcggtggttactcaggtggcgcagcttcatacgtcgccccaggaggtggttaccaatacggaaatgctcactctggccagggcggcgatgccggaggaaatggacaaaatgcctggtctgatggtggtaaagttctaaaggttggtgcaggaggagcagcaggttatgctgtcataggatctgctccaacttggcaaaatgttggagtaatatatggtccaagagtataattttgaataaatacccctaaaaggagggtctatggcagcacctagaatatcattttcgccctctgatattctatttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatatagtgaaattattgaaaaggaaagaaatgcacgctttgaatctgtcgccctggaacaactccagatagttcatatatcatctgaggcagactttagtgcggtatattctttccgccctaaaaacttaaactattttgttgatattatagcatatgaaggaagattaccttcaacaataactgaaaaatcacttggaggatatcctgttgataaaactatggatgaatatacagttcatttaaatggacgtcattattattccaactcaaaatttgcttttttaccaactaaaaagcctactcccgaaataaactacatgtacagttgtccatattttaatttggataatatctatgctggaacgataaccatgtactggtatagaaatgatcatataagtaatgaccgccttgaatcaatatgtgctcaggcggccagaatattaggaagggctaaataattatttgttcgtatacatctctagatatcgatatacaccctcaaaaccctcgttgaattcgtcgatgagggttttcttatcttcttgagttaattcagaaacaattttacgaaatgaattctgatttaactttctaccttcatgcgttactccaatctcattaagaaatgcaataaaattagcacgattctcaacaatatcttctctggaaaatttaatcaaaatagatgcaacagtaataatttcacgaactgtatcaatgtttttattcattaactataccactcaattagttgactttgttataatatcatcagacgcttgatttgtaaactggtctgtgttattttcttcaaaaattttttctacgaattccttgaacgactcgcgttcctgagctacattatgctcgattaccttttcaagattatgactcattcgaaataatcttcaatttcgtaatcatggacataaatcattatagtttttaatacatcatcaatactttttcctggagctggaattacgtaaaaatatcctgcttttgagaggtctttataggttccaatcaagaaatcattattctcaagatgcagttcttcaactaattcattggcaattgagtggtataaatttggtaaaaacttatatagcttttctagaatatcaattttgattgtgtattgaaccacagattgagaatcaataatcatagaccttccccttatgtttctgtttgcgattagattctttaaacgctttcttcttatccttatgaacagaagctttattaaaattatgctttgcgactaaattgttcatagtgctgaattacctctcttaaacatttgcatgtgaatgaaaactttttagctacaccacattcaaatatatgttctcttaaatcacgtgtgtcagtatatcccatctcaacaataaaatgccgtattagatttttatctttatcgttgagagaattaaaataatcggattttgaattaatttccctggccaaattgaatcaccttcagttgacgttttagctcttttatcatctcttcgttcatcgcaatataaagatcgcgtaaagcaagttttagcattccatttactggataactaaatggacatacataatcttttcctacgagctttttagtgaattccatatcacagaactgaaatgccggttcatttgtataaattccccaattagttgacatcattttattggcatattccaacgcttggatttaattcgtaattccatcaatttgaaactttttaatattcattagtaaaggtcctcagagtaaagttctttttcattaccaccacgttcaatacgtacttgtccagcgtaagttgcaataatcattgcttcttcacgtgtccaataattactatattggtcaataaacccttggtcatcatcacaaacttgttgagtaactaattgaggtttaactacatctaaaacttctgccatatctttagaataatgacgagcacctggaataataagagttcgtccatcttttaatttaaaacgattagctgcgcagacaattcgtcgttgatacttttggttttcatcccaatacgcagtctgccaacaaatttcaggaacttctttcagaatatcttcttctgtgcatttataaccatgcgctttaaatttttcaacaagactttctggagtttcacgagataaaggaacattcagcatttttaaacgattaataaatgggttcatttaaaccatcctttaatacgttgccataaagttttctgttgagctttgttaacaccaattgaacgaataactggttgagattcctggaattctttataatcagcaaggtaaatttcgtaagctgcatccgtaaatgaacttatcgccgccataaaattattgcgaatacctactggagcatctttactttcacgaataatcatgtatttaccagtcttaatctttacaatagttccaagataagccccatggtaccagatgtcccatccctcttgagtgggttctgcgcaacgacgaagttcattaacaatttctaacttgttcattatttattcctcacagttcagatgctacagtgattactgcttcaatgttttctgccgaacgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcaagatagttactgcggtaagtttcaacctttttaagaacaaatccattttcatctaaaagttttagcataaggtctttatcttcttccatatcggaagtaatctcacgagctttacgagttgctcgttttttcagtagttcaggagcattttcctgtgcatataaagttgccgcatttgaaataatatcctgagcttcaccagtaatgattaatccatcaccagatttctccaccaggccttttttaatcaataccccaatattactattaactactgcgttacctaaatctggatgcacctcacgaacttctgcagctgtaatgaaatctttcttagcaatggtaattaaaatcgcagcagttttttcattcagaatatcgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcatttttttgtatctccgggttgtttgtttcagttcatttatttgatagttgtatagtaccacagtatgctttggttgtaaaccgttttgtgaaaaaatttttgaaataaaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagcttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatggcgttcttcttcattatcgctcaaagagtattcttttcggaatttaactttgaagccaaagccatgctcaccacaagcatcatcccatgtaatgaagcctttatcttcaagcgggtctaagattttactcacataagtttcacgatcatacttatacggaatctcagtgatatgcatttgagttcgtgaagtaaacttatatgttccacgaatttcatattgaccgtcaatctcaacgacttcaccacgaaattctgggaattctaccttcggtttagttactttctttccttgaagagcttgcagtacagctttcttaacagaagaaacactatgaggaagaatgtaagttgcataaccagttgcaataccggaaacgccattaagaagaacagtaggaataataggcaaatagaaagcaggcggaatgtgttctttatcttgatgtaccggagcatattcagtatctttatatacgttatagaaatttttacttacacgagcaaaaatataacgacttgctgctgccttttggacagtacgagaaccgaagtttccttgaccatctaacaaaggaaaattattattccaagtattagccatcaaagcgcctgcgtcttgtgcagagttttcgccatggtgatatccaaggtccgctacaccacctgcaatagaagcgagtttgtgaaacttatctttatttcctcgtgccaaatcaagagctcgagcaataacaaatcgttgaactggcttaaatccatcaatcatatttgggatagcacgattttcaaccgtgtacatagcataagccaatgcttcattatcaatgatactttttaaatcgcgattattcagttgcataaatttaccatactagtgaatgtagtgccataataacatcagaaatgaaaagcacgacttgaattaatccgaacattattccgtaatataacgctatcaataaaatagcaagggctaatgaatagcccaagattttcttaatcattagataacaacacaaatgttaaatatgcacacataccttgggctaaagcctgcgaaaacacactgctggcatcgatacagatagttaaaacacatgctactatccaacaaataaatgaaataactcctaataattttgcgatattcatattttcctcactggcgtccgaagacgcctttagttttaagattgttacgatagaactgcatcacatgttcgttatggaaattactcattaatatgcctgcaaaacaaatttaaagttatcagccaacatacggttcatttcttcaagtgtttgatactcagaatgatgattacgagtaaacgccaacgctaactgacctttatcaaatcctgtcgtcagaggtttcatcttagaagcaggaagataaaatactgtgtatggaacattgttatttgcaatagtacgcgcaagctgagaccgacgctgacgaatatgacttagaaccgcactgaatccttgcttagaacgctgattacctacataaaatcgtgcagacacacatggattactaaatggacgaccatctaatttacttactaaaaagtaaaatccaggtttagataaaatgtctttatgcggagttcccaaaaaccattcaccgcccttgattgtgccaataacagtagcgcctgcattattcagatcagtaacagtcatgtatttcatattaatttcctctaaattattttctactccaaggccgcatgaatacacgcggccattaaattaatcgtcgcagtcgacgctcaattcccaaaactcttctacggtataagtttcagtatcattttcaatacagaaacgttcattactgttatttgctaaagtagcgttaactgtcattttctcgctggtgctcttaagaggtgaaatacgaattaactgatcaccactatccaagcaaaaaatttcgccaacttttacatctttaaaaattttcataattcacctcagggagtataaaatccaaatgcagttgttgaccatcccatccaatatgggaaatttgcaccaatgtaaaacataagaatataaaaccaaccactcagcaaattcatcattttacaccattccaaattgtttcaaccacggattttaaaccattttgatgaatatccattccgactaccgtcatcaaataaattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaagcgtttaatacatcaatcattaaaacgattgggaatatactcaaaactactagtattataactacattccatatagctttaacaatctttttcattttctgttcctccgtagttgatagggtaatagtaccacggaagaacagtcttgtaaacaactttttttaaaaatattcgtaataaatgtgaataccaactactaccgctgaaacctgtgcaacccaccacgcacaagcaataagtacagaattcaaaattttcataataacctcattacaaaagtaaatgttaaacaaattactggaatactaattaaccaaacaaaacaccaacataatgaactcatagttcaatctcaacgatttccaagtgtttttgttttattgcctttttaacacaatcatggactaaatatgaccatgaatcattatattctccattaactaatcgttggagatcttcacgtgatgataagtaaggttgatctgattcccattttgataaaaatactgcagtaaaaatatctctttcatctgtagttgaagtcgtaaatgcaataaattcaccggtaattttatgtttagcgtaataaaatttaaatttcatttttactcctccgtagctgatagttgtatagtaccacggtccttgtggtatgtaaactgttttgtgaaaatttttttaaatggaaagataccatccattgtagttgctttttcttacaaccttacgaaggtcttctctgtcaccgatgaacttcggagtgtactggataacacctggatgaatttctttagtgttgaatataattatacagtcagcgacttgatgatttagaatgggccctagatttattccagaaccgtatggatactctccgctgcatcctgttgttacagaaatccaacgtgagccagtttgatgtgtcttaacttctacacgaagcccacagtattttggatgtgctaaaacatcccacgcgtatgtatatggatcatcgacatcttcttgacctttattaacatacccgcttagccaatctgctacaaaaaactctgcgtatacagcaatacgacatctttcaataacttctgctttatcctggttcgggttttgttttaaagagtatcttgcagtatcagcaattttgaccttcatttcgctagtcaagtcactgttcgatagggtaaatgtcggaatctgaaatagtctctgtaaacccggattcgttttctgcatttagactttcctttttaccactgagataagcgttatatactttaagagtgccgtaataaattcggtcattttcatctaaagactcgcggtcaagttcatcgagctcctttttatccatgactataacatcattacagtaaagaaacccaagtttttcgtgaccaaactcaaatttattacagtacacaatattagcgtgatgatttccgtgcagtttaatctcttttatgtcggaatcaccgatattcatacaataaatcataatttttccttaaaacaaaagggccaaagccctttattttacttgaattgtgcaattcttttctctagacattcagcataagatttcattgagatgaactgtgaaagtagcagttcttgctcaactacactaactgttagaaactttgcgctttctaaaaatttactcagtgcattaattttgagcattaattgatcgtattcttcttttactcgtgcttgataacctaacataattttcctcagttaagggccgaagcccttatttaaattgttcagtaacgtcttcaactacttcgtattggcaggtacgcattttagcatcgttgtaatcaatcggaattgatactacatcacgcggatgtactttaacttttacaactcggctagttgaactgccaaagtgacgaatataagatttagaacacacatgcagaccgcgagaacaagtttgtgtatcatcgtcattcacacgagtacgtggcattttaactactttaccagggctgttatcaaaagtatttgaatgacagtcaaagtaattactgcgaactactttccaagcatagaagtaaccgtcttctgtaatttcaatatcgtttgctaccaagaaatcaaagagtcgagataccgctttttggcttgggttttccaacagattttccaagaacggaaaatagaattcaaagttttcgcctttttccatcgagtcaagaatacgatcaaccaaaccagatcgcaattcaatattttgatagaacaagcttccaccttcaattcgaacatcgcctgaaatatatttttcaacagcgcgacgaacattaattttttgtgccgcttcttccaacttatccgctacaagcagattaagaatttcctggaagtttgaatgagtattaggagttgcgttataagttacaccgtcaacagtaattgaaatgaattttttagatgcattccaaataatgtcagatttagcaactggagcaataactgcatcgctattaactttaactgtaatatcaccgctaatagtaactttagagcgtttagcttcttcggcatttttcaaaacacgacggattgtgtcaaccgatacaccttgccaatcagccaattcctgttgggtgtaattaccacttgaatacagtttaacaatttcagcttgttcgtttttggtcaggcatttaatattgtacataattttcctta

The invention claimed is:

1. A method of treating a bacterial associated cancer bacterial infection in a patient, the method comprising administering to the patient a composition comprising at least two obligately lytic bacteriophages that infect and lyse a bacterium, and wherein a) the bacteriophages are selected from Ec34 (SEQ ID NO:2), Ec35 (SEQ ID NO:3), Ec45 (SEQ ID NO:4), and Ec57 (SEQ ID NO:6), and wherein the target bacteria are *Escherichia coli*; or b) wherein the bacteriophages are selected from Bf1 (deposited with the International Depositary Authority of Canada under Accession No. 040219-02), Bf2 (deposited with the International Depositary Authority of Canada under Accession No. 040219-03), Bf3 (deposited with the International Depositary Authority of Canada under Accession No. 040219-04), and Bf4

(deposited with the International Depositary Authority of Canada under Accession No. 040219-05) and wherein the target bacteria are *Bacteroides fragilis*.

2. The method of claim 1, wherein the patient has a confirmed infection with *Escherichia coli* or *Bacteroides fragilis*.

3. The method of claim 1, wherein the bacterium is associated with a bacterial-associated cancer selected from colorectal cancer, esophageal cancer, gallbladder cancer, lung cancer, squamous cell carcinoma, bladder cancer, stomach cancer, or MALT lymphoma.

4. The method of claim 1, wherein the *E. coli* are pks+*E. coli*, and/or wherein the *Bacteroides fragilis* are enterotoxigenic *Bacteroides fragilis* (ETBF).

5. The method of claim 1, wherein the bacteriophages are specific for the bacteria and do not target other microorganisms.

6. The method of claim 1, wherein the composition further comprises an antibiotic, and/or wherein the method further comprises administering an antibiotic to the subject.

7. The method of claim 1, wherein the patient has been screened for a genetic mutation that predisposes the patient to cancer.

8. The method of claim 1, wherein the composition further comprises a pharmaceutically acceptable carrier, diluent, excipient or combinations thereof comprising calcium salt or magnesium salt.

9. The method of claim 1, wherein the bacteria are characterized by the presence of a bacterial biofilm and are resistant to antibiotics.

10. The method of claim 1, wherein the composition is administered via an oral formulation of the composition.

11. The method of claim 1, wherein the composition is administered intravenously.

12. The method of claim 1, further comprising administering the composition in combination with an immunotherapeutic agent, wherein the immunotherapeutic agent comprises an immune checkpoint inhibitor selected from anti-PD-1, anti-PD-L1, anti-CTLA-4, anti-CD27, or anti-IDO-1.

13. The method of claim 1, further comprising administering the composition in combination with a chemotherapeutic agent, and wherein the chemotherapeutic agent is 5-Fluorouracil (5-FU), capecitabine, irinotecan, oxaliplatin, Trifluridine and/or tipiracil.

14. A method for treating a bacterial infection in a patient in need thereof, the method comprising administering to the patient a composition comprising one or more obligately lytic bacteriophages that infect and lyse a bacterium, wherein the bacteriophages target at least one bacterial species that is associated with colorectal cancer; and wherein
 a) the bacteriophages are selected from Ec34 (SEQ ID NO:2), Ec35 (SEQ ID NO:3), Ec45 (SEQ ID NO:4), and Ec57 (SEQ ID NO:6), and wherein the target bacteria are *Escherichia coli*; or
 b) wherein the bacteriophages are selected from Bf1 (deposited with the International Depositary Authority of Canada under Accession No. 040219-02), Bf2 (deposited with the International Depositary Authority of Canada under Accession No. 040219-03), Bf3 (deposited with the International Depositary Authority of Canada under Accession No. 040219-04), and Bf4 (deposited with the International Depositary Authority of Canada under Accession No. 040219-05) and wherein the target bacteria are *Bacteroides fragilis*.

15. A human therapeutic bacteriophage composition formulated for treating a bacterial infection in a subject in need thereof, comprising one or more obligately lytic bacteriophages that infect and lyse a bacterium, the bacteriophages having a narrow spectrum of activity against the target bacteria, wherein each individual bacteriophage is not prone to generalized transduction and does not carry antibiotic resistance genes, wherein the composition is substantially free of bacterial components; wherein the composition comprises a single dosage of $1 \times 10^5$ to $1 \times 10^{11}$ PFU of each phage per mL of composition; and wherein
 a) the bacteriophages are selected from Ec34 (SEQ ID NO:2), Ec35 (SEQ ID NO:3), Ec45 (SEQ ID NO:4), and Ec57 (SEQ ID NO:6), and wherein the target bacteria are *Escherichia coli*; or
 b) wherein the bacteriophages are selected from Bf1 (deposited with the International Depositary Authority of Canada under Accession No. 040219-02), Bf2 (deposited with the International Depositary Authority of Canada under Accession No. 040219-03), Bf3 (deposited with the International Depositary Authority of Canada under Accession No. 040219-04), and Bf4 (deposited with the International Depositary Authority of Canada under Accession No. 040219-05) and wherein the target bacteria are *Bacteroides fragilis*.

16. The method of claim 1, wherein the composition further comprises a cryoprotectant, and wherein the cryoprotectant comprises 10% sucrose or between about 5% and about 50% glycerol.

17. The method of claim 1, comprising about a 1:1 ratio of the at least two of bacteriophages.

18. A composition comprising a bacteriophage composition according to claim 15, formulated for oral delivery.

19. A composition comprising a bacteriophage composition according to claim 15, wherein the composition is frozen, lyophilized, liquid, or solid.

20. A method of treating a bacterial infection comprising:
 a) selecting a patient with a confirmed bacterial-associated cancer and,
 b) administering the bacteriophage composition according to claim 15 to the subject.

21. A kit comprising:
 a. A bacteriophage composition according to claim 15; and
 b. Instructions for use of same.

22. The method of claim 1, wherein the patient is known to have a cancer.

23. The method of claim 22, wherein the cancer is selected from the group consisting of colorectal cancer, esophageal cancer, gallbladder cancer, lung cancer, squamous cell carcinoma, bladder cancer, stomach cancer, or MALT lymphoma.

24. The method of claim 1, wherein the patient is known to have a colorectal cancer.

* * * * *